(12) United States Patent  
Chen et al.

(10) Patent No.: US 12,648,973 B2  
(45) Date of Patent: Jun. 9, 2026

(54) ACTIVE SUBSTANCE OF *Lactobacillus plantarum* GKM3, A COMPOSITION COMPRISING THEREOF AND ITS USE FOR PROMOTING LONGEVITY

(71) Applicant: GRAPE KING BIO LTD., Taoyuan City (TW)

(72) Inventors: Chin-Chu Chen, Taoyuan City (TW); Yen-Lien Chen, Taoyuan City (TW); Shin-Wei Lin, Taoyuan City (TW); Yen-Po Chen, Taoyuan City (TW); Ci-Sian Wang, Taoyuan City (TW); Yu-Hsin Hou, Taoyuan City (TW); Yang-Tzu Shih, Taoyuan City (TW); Ching-Wen Lin, Taoyuan City (TW); Ya-Jyun Chen, Taoyuan City (TW); Jia-Lin Jiang, Taoyuan City (TW)

(73) Assignee: GRAPE KING BIO LTD., Taoyuan City (TW)

( * ) Notice: Subject to any disclaimer, the term of this patent is extended or adjusted under 35 U.S.C. 154(b) by 686 days.

(21) Appl. No.: 17/583,859

(22) Filed: Jan. 25, 2022

(65) Prior Publication Data

US 2022/0143114 A1 May 12, 2022

Related U.S. Application Data

(62) Division of application No. 16/541,407, filed on Aug. 15, 2019, now abandoned.

(30) Foreign Application Priority Data

Aug. 16, 2018 (TW) .................................. 107128658

(51) Int. Cl.
| | |
|---|---|
| *A61K 35/747* | (2015.01) |
| *A23L 33/135* | (2016.01) |
| *A61K 9/19* | (2006.01) |
| *C12N 1/205* | (2026.01) |
| *A61K 35/00* | (2006.01) |
| *C12R 1/25* | (2006.01) |

(52) U.S. Cl.  
CPC .......... *A61K 35/747* (2013.01); *A23L 33/135* (2016.08); *A61K 9/19* (2013.01); *C12N 1/205* (2021.05); *A23V 2002/00* (2013.01); *A23V 2400/169* (2023.08); *A61K 2035/115* (2013.01); *C12R 2001/25* (2021.05)

(58) Field of Classification Search  
CPC .. A61K 35/747; A61K 2035/115; A61K 9/19; A23V 2400/169; A23V 2002/00; C12R 2001/25; A61P 25/00; A61P 21/00; A61P 25/28; A23L 33/135  
See application file for complete search history.

(56) References Cited

U.S. PATENT DOCUMENTS

| | | | | |
|---|---|---|---|---|
| 9,096,874 B2 * | 8/2015 | Shibamoto | ................ | C12P 7/56 |
| 2016/0067289 A1 | 3/2016 | Berggren et al. | | |

FOREIGN PATENT DOCUMENTS

| | | | | | |
|---|---|---|---|---|---|
| CN | 105505814 A | * | 4/2016 | ............... | C12N 1/20 |
| CN | 106399163 A | * | 2/2017 | ............... | C12N 1/20 |

OTHER PUBLICATIONS

Manzoor et al. Significantly enhanced biomass production of a novel bio-therapeutic strain Lactobacillus plantarum (AS-14) by developing low cost media cultivation. Journal of Biological Engineering. 2017;11(17):1-10.*  
Natarajan et al. Evaluation and optimization of food-grade tannin acyl hydrolase production by a probiotic Lactobacillus plantarum strain in submerged and solid state fermentation. Food and Bioproducts Processing. 2012;90:780-792.*  
Nualkaekul et al. Survival of freeze dried Lactobacillus plantarum in instant fruit powders and reconstituted fruit juices. Food Research Internationsl. 2012;48:627-633.*  
Wu et al. A persistent level of Cisd2 extends healthy lifespan and delays aging in mice. Hum Mol Genet. 2012;21(18):3956-68.*  
Grosicki et al. Gut Microbiota Contribute to Age-Related Changes in Skeletal Muscle Size, Composition, and Function: Biological Basis for a Gut-Muscle Axis. Calcif Tissue Int. 2018;102(4):433-442.*  
Pearson, "Supplement Delivery Methods: What's Best?" education. seekinghealth.com. 2017; pp. 1-4.

* cited by examiner

*Primary Examiner* — Lynn Y Fan  
(74) *Attorney, Agent, or Firm* — Birch, Stewart, Kolasch & Birch, LLP

(57) ABSTRACT

The present invention provides an active substance of Lactic Acid Bacteria, a composition comprising thereof and its use for promoting longevity, especially for increasing Cisd2 gene expression, reducing mitochondrial damage and delaying aging conditions such as nerve degeneration and sarcopenia.

12 Claims, 6 Drawing Sheets

Specification includes a Sequence Listing.

3-month old female and male SAMP8 mice (10 mice per group)

↓

Ambient temperature 25±2°C, humidity 65±5%

Light/dark cycle: 19:00-07:00 (light), 07:00-19:00 (dark)

Tube-feeding samples once per day

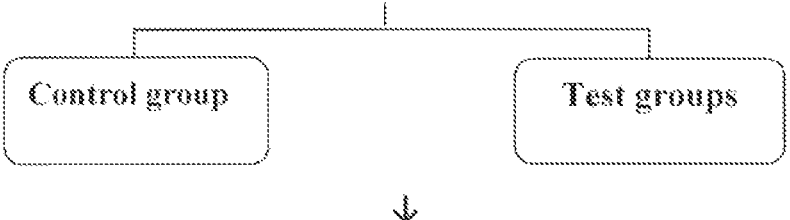

Control group

Test groups

↓

Recording of mice's food & water intake and weight during the experiment

↓

Week 12: aging score measurement

Single-trial passive avoidance test

↓

Week 13: Forearm grip strength test and active shuttle avoidance test

↓

Sacrifice of animals

Fig.4

ACTIVE SUBSTANCE OF *Lactobacillus plantarum* GKM3, A COMPOSITION COMPRISING THEREOF AND ITS USE FOR PROMOTING LONGEVITY

CROSS-REFERENCE TO RELATED APPLICATIONS

This application is a Divisional of U.S. patent application Ser. No. 16/541,407, filed Aug. 15, 2019, which claims priority under 35 U.S.C. § 119 to Taiwanese Patent Application No. 107128658 filed on Aug. 16, 2018, the disclosures of which are hereby incorporated by reference in their entireties.

BACKGROUND

Technical Field

The present invention relates to an active substance of *Lactobacillus plantarum*, a composition comprising thereof and its use for promoting longevity. More specifically, the present invention relates to a composition comprising the active substance, the method for manufacturing the active substance of *Lactobacillus plantarum* GKM3, and the application of GKM3 to increase Cisd2 gene expression, reduce mitochondrial damage and delay aging conditions such as nerve degeneration and sarcopenia when administered to a subject.

Description of Related Art

Longevity Genes

Scientists have long desired to unravel the mystery of longevity. As it has been postulated that the better adjustment to environmental stresses can result in a longer lifespan, the scientists began to search for a group of longevity-affecting genes that relates to environmental stresses (such as extreme weather like scorching heat, or extreme hunger due to lack of food and water). These genes, regardless of the age of the individuals to which they belong, may be able and continue to protect individuals and restore their activity in a natural way, so as to fortify them and help them survive through crises they face. Such genes, also called "longevity genes," may therefore help to improve health and prolong the longevity of individuals significantly as long as they remain active for a long period.

Another group of scientists chose to perform genetic testing on centenarians. They have found that expression levels of certain genes in centenarians are significantly stronger when compared to those in people with average longevity. Therefore, it was postulated that these genes may play a role in determining lifespan.

Cisd2 Gene

Cisd2 gene is a highly evolutionarily conserved gene that can be found in a variety of species, including lower invertebrates, vertebrates and higher mammals. In this respect, Cisd2 gene seems to play a key role in controlling important biological functions. The proteins of Cisd2 gene are expressed on the mitochondrial outer membrane, and a lack of Cisd2 gene in the mitochondria typically leads to mitochondrial damage that undermines the mitochondrial structure and functions and in turn leads to aging. Research on Cisd2 gene knockout mice has shown that they are not only significantly smaller than the control group but also their average life expectancy is barely half of that of the control group. Additionally, Cisd2-knockout mice start to exhibit nerve degeneration and sarcopenia around week 3 (equal to 10 to 12 human years), significant weight loss around week 4 (equal to around 15 human years), protruding eyeballs with white and cloudy spots and osteoporosis around week 8 (equal to around 18-20 human years), and hunchback, blindness, and loose skin around week 12 to 48 (equal to around 30-45 human years). It was further observed that Cisd2 gene expression in normal mice decreases as age increases: the expression drops to 60% around month 14 (equal to around 60 human years) and drops to 30% around month 28 (equal to around 90 human years), when compared mice at young age. Based on past studies and observations listed above, it is confirmed that Cisd2 gene is indispensable for maintaining a normal life expectancy, and is highly associated with aging.

*Lactobacillus* spp.

*Lactobacillus* spp. exist in general environmental conditions and is able to ferment carbohydrates into lactic acid, thereby are often used for manufacturing fermented foods. In the early 1900s, *Lactobacillus* spp. was discovered to bring multiple health benefits such as improving digestion and gut health. Thus, it is recommended to consume *Lactobacillus* spp. for boosting digestive functions and bowel movements. It was further discovered in other studies that lactic acid bacteria can dissolve carbohydrates (such as lactose, glucose, sucrose and fructose) and produce lactic acid and acetic acid, which in turn promotes gut acidification to prevent bad bacteria from proliferating, and allow gut flora to keep a healthy balance.

*Lactobacillus* spp. bacteria, whether of different species or of the same species but different strains, may have distinct characteristics and effects on the human body. For example, it has been found that *Lactobacillus plantarum* may be beneficial to human health. In particular, *L. plantarum* PH04 may lower blood cholesterol; *L. plantarum* 299V may reduce colitis symptoms in IL-10-deficient mice; *L. plantarum* 10hk2 may increase levels of pro-inflammatory mediators, such as interleukin-1β (IL-1β), IL-6 and TNF-α, as well as increase levels of anti-inflammatory mediator IL-10 to counteract inflammation; and *L. plantarum* K21 may lower blood cholesterol and triglyceride, as well as counteract inflammation.

*Bifidobacterium*

*Bifidobacterium* is a genus of gram-positive, nonmotile, rod-shaped and often branched anaerobic bacteria. They are ubiquitous inhabitants of the gastrointestinal tract, vagina and mouth of human and animals. In 1899, they were first isolated from feces of healthy infants, and it was later discovered that certain *Bifidobacterium* strains can be used as probiotics to be added in foods, medicine and feeds.

However, the effects of lactic acid bacteria on longevity have never been mentioned in related studies. Nor have there been experiments which attempt to demonstrate how lactic acid bacteria determine an individual's longevity by altering the physiological conditions thereof through Cisd2 gene expression.

SUMMARY

One object of the present invention is to provide a longevity-promoting composition comprising a *Lactobacil-*

*lus plantarum*, wherein the *Lactobacillus plantarum* is deposited (No. BCRC14565) at China General Microbiological Culture Collection Center (CGMCC) on Aug. 25, 2017 (Institute of Microbiology, Chinese Academy of Sciences, Datun Road, Chaoyang District, Beijing 100101, China).

Another object of the present invention is to provide a longevity-promoting composition comprising an active substance of *Lactobacillus plantarum* of an effective amount, wherein the *Lactobacillus plantarum* is deposited (No.14565) at China General Microbiological Culture Collection Center (CGMCC) on Aug. 25, 2017 (Institute of Microbiology, Chinese Academy of Sciences, Datun Road, Chaoyang District, Beijing 100101, China).

Preferably, the active substance is prepared by the following method:

(a) Streaking bifidobacterial strains onto a solid-state media to produce single colonies; and (b) Inoculating a single colony of lactic acid bacteria cultured at step (a) to a liquid culture for liquid-state culture.

Preferably, the method further comprises the following steps:

(c) Centrifuging the liquid culture containing lactic acid bacteria colony that was cultured at step (b) to obtain a bacterial pellet; and (d) Freeze-dry the bacterial pellet obtained at step (c).

Preferably, step (b) is carried out at 30 to 50° C., in nitrogen or carbon dioxide of 0 to 1 VVM, shake at 10 to 100 rpm, and/or incubate for 16 to 24 hours.

Preferably, the temperature for the freeze-drying at step (d) is −196 to −40° C.

Preferably, the composition includes an additive selected from the group consisting of an excipient, preservative, diluent, filler, absorption enhancer, sweetener and a combination thereof.

Preferably, the composition is a drug, feed, drink, nutritional supplement, dairy product or health food.

Preferably, the composition takes the form of a powder, tablet, granule, suppository, microcapsule, ampoule/ampule, liquid spray or suppository form.

Yet another object of the present invention is to provide a method for manufacturing a composition for promoting longevity.

Preferably, in terms of the method for promoting longevity, a subject having been administered the active substance exhibits increased Cisd2 gene expression compared to a subject that has not been administered the active substance.

Preferably, in terms of the method for promoting longevity, a subject having been administered the active substance exhibits reduced and delayed mitochondrial damage compared to a subject that has not been administered the active substance.

Preferably, in terms of the method for promoting longevity, a subject having been administered the active substance exhibits delayed aging conditions of nerve degeneration, sarcopenia or a combination thereof, compared to a subject that has not been administered the active substance.

BRIEF DESCRIPTION OF THE DRAWINGS

FIG. 4 shows the procedure for the animal experiments.

DETAILED DESCRIPTION

Source of Lactic Acid Bacteria

Figure 1:
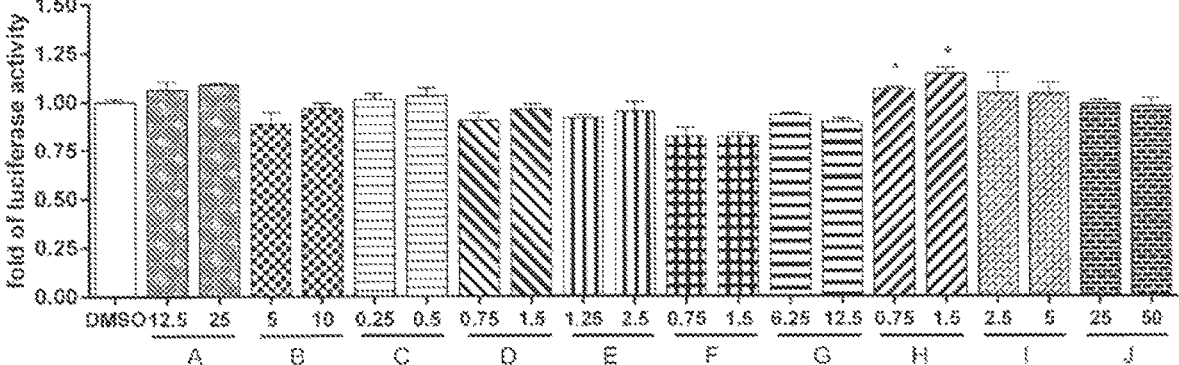
FIG. 1 shows the relative expression levels of Cisd2 gene promoter-controlled fluorescence intensity in HEK293 cells after treating with different lactic acid bacteria (number A to J) active substances at different doses.

The lactic acid bacteria used in the present invention include *Lactobacillus plantarum* and *Bifidobacterium*. In a preferred embodiment, the lactic acid bacteria of the present invention are purchased from the Bioresource Collection and Research Center at Taiwan Food Industry Research and Development Institute. In a preferred embodiment, the lactic acid bacteria used in the following experiments are numbered A to J. The strain and deposit number of each numbered bacteria are shown in Table 1 below. Processes of collection, isolation and purification, as well as results of genetic analysis and assay of bacteria A to H are described in Taiwan patent application No. 106137773 and No. 106136134.

TABLE 1

| Numbers, strains and deposit numbers of lactic acid bacteria | | |
| --- | --- | --- |
| No. | Strain | Deposit number |
| A | *Lactobacillus paracasei* GKS6 | BCRC-910788 |
| | | CGMCC-14566 |
| B | *Lactobacillus johnsonii* | BCRC-19194 |
| C | *Lactobacillus brevis* | BCRC-12187 |
| D | *Lactobacillus plantarum* | BCRC-80061 |
| E | *Lactobacillus plantarum* | BCRC-80581 |
| F | *Lactobacillus plantarum* | BCRC-80577 |
| G | *Lactobacillus plantarum* | BCRC-80578 |
| H | *Lactobacillus plantarum* GKM3 | BCRC-910787 |
| | | CGMCC-14565 |
| I | *Bifidobacterium lactis* GKK2 | BCRC-910826 |
| | | CGMCC-15205 |
| J | *Bifidobacterium lactis* | BCRC-17394 |

Culture of Lactic Acid Bacteria 10 lactic acid bacteria (A to J) listed above were streaked onto a solid-state medium to produce a single colony. In a preferred embodiment, the solid-state medium is MRS agar. Once fully grown, a single colony of lactic acid bacteria is inoculated into a flask containing a liquid medium for liquid culture. In a preferred embodiment, the lactic acid bacteria are cultured in a liquid medium at 35-50° C., in nitrogen or carbon dioxide of 0 to 1 VVM, and rotate at 10 to 100 rpm. In a preferred embodiment, the bacteria are cultured for 16 to 24 hours, more preferably for 18 hours. In a preferred embodiment, the liquid medium is MRS liquid medium. In a preferred embodiment, the ingredients of the liquid medium are shown in Table 2 below.

TABLE 2

| Ingredients of the liquid medium | |
| --- | --- |
| Ingredient | Percentage |
| Glucose | 1~10% |
| Yeast extract | 0.1~5% |
| Peptone | 0.1~5% |
| Trace element | 0.01~2% |
| Cysteine | 0.01~0.1% |
| Tween-80 | 0.05~1% |

Preparation of Freeze-Dried Powder

Once each strain of lactic acid bacteria is fully grown in liquid culture, the lactic acid bacteria are centrifuged to obtain bacterial pellets. In a preferred embodiment, liquid media containing lactic acid bacteria are centrifuged at 1000 to 15000 rpm. The obtained bacterial pellets are mixed with a protecting agent (6-30% skimmed milk powder) and freeze-dried to be preserved at a low temperature. In a preferred embodiment, the freezing temperature is set at −196 to −40° C. In a preferred embodiment, the mixture is freeze-dried for 16 to 72 hours. In a preferred embodiment, the freeze-dried mixture is preserved at −30 to 0° C. The freeze-dried powder of lactic acid bacteria is preserved to be used as an ingredient for the following cell experiments, that is, as one of the embodiments of the lactic acid bacteria active substance claimed by the present application. The embodiments of the lactic acid bacteria active substance claimed by the present application also include the pellet obtained from culturing a single bacterial colony in liquid media as described above.

Cisd2 Luciferase Reporter Gene Assay

A human embryonic kidney cell (HEK293) platform (from Yang-Ming University, Taiwan) that fuses Cisd2 gene promoter, cisd2 gene and luciferase reporter gene, is performed to see whether the active substance of lactic acid bacteria affects Cisd2 gene expression. HEK293 cells carrying luciferase reporter genes ($2 \times 10^5$ cell/mL) are inoculated onto a 6-well plate and incubated in an incubator at 37° C. in 5% $CO_2$ for a day. The preserved freeze-dried powder of the 10 listed above lactic acid bacteria (A-J) is then dissolved in 0.1% DMSO, which serves as a carrier. Various concentrations are prepared from the resulting mixture as shown in Table 3 below, and are added into the HEK293 liquid medium, respectively. In the control group, only the carrier of 0.1% DMSO is added into HEK293 liquid medium while the experimental groups are incubated with different lactic acid bacteria active substance. Both groups are incubated in an incubator at 37° C. in 5% $CO_2$ for 24 hours. The luciferase activity of HEK293 cells is measured and quantified. The above experiment is performed in triplicates. The results are illustrated in FIG. 1.

TABLE 3

| Concentrations of lactic acid bacteria (A to J) freeze-dried powders | | |
| --- | --- | --- |
| No. | Concentration 1 (µg/ml) | Concentration 2 (µg/ml) |
| A | 12.5 | 25 |
| B | 5 | 10 |
| C | 0.25 | 0.5 |
| D | 0.75 | 1.5 |
| E | 1.25 | 2.5 |
| F | 0.75 | 1.5 |
| G | 6.25 | 12.5 |
| H | 0.75 | 1.5 |
| I | 2.5 | 5 |
| J | 25 | 50 |

Endogenous Cisd2 Expression Levels

Figure 2:
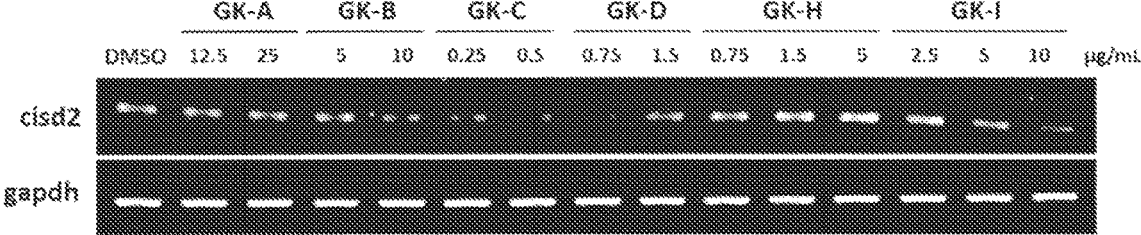
FIG. 2 shows the gel image of the expression levels of endogenous Cisd2 message RNA (mRNA) after treating HEK293 cells with different lactic acid bacteria (number A, B, C, D, H and I) active substances at different doses, respectively.

The activity of endogenous Cisd2 gene is measured to further determine the effects of lactic acid bacteria active substances on Cisd2 expression levels. First, normal HEK293 cells ($2 \times 10^5$ cell/mL) are inoculated onto a 6-well plate and incubated at 37° C. with 5% $CO_2$ in an incubator for a day. Freeze-dried powders of lactic acid bacteria numbered A, B, C, D, H and I are then dissolved in 0.1% DMSO carrier and prepared into mixtures at various concentrations as shown in Table 4 below. Each mixture is then added into a HEK293 cell culture. In the control group, only carrier of 0.1% DMSO is added into the HEK293 cell culture while the experimental groups are incubated with the lactic acid bacteria active substance. Both groups are incubated in an incubator for 24 hours. Cells are then scraped on ice and mRNA is extracted therefrom using the commercially available GeneJET RNA Purification Kit (Thermo). The mRNA extract is adjusted to appropriate concentrations and then reverted into cDNA using the RevertAid H Minus First Strand cDNA Synthesis Kit (Thermo). Finally, endogenous Cisd2 gene expression levels are measured using PCR. The gel image of the results is shown in FIG. 2, and the results in FIG. 2 are statistically analyzed and shown in FIG. 3.

TABLE 4

| Concentrations of lactic acid bacteria (A, B, C, D, H and I) freeze-dried powders | | | |
| --- | --- | --- | --- |
| No. | Concentration 1 (µg/ml) | Concentration 2 (µg/ml) | Concentration 3 (µg/ml) |
| A | 12.5 | 25 | N/A |
| B | 5 | 10 | N/A |
| C | 0.25 | 0.5 | NIA |
| D | 0.75 | 1.5 | N/A |
| H | 0.75 | 1.5 | 5 |
| I | 2.5 | 5 | 10 |

Statistical Method for Analyzing Cisd2 Experimental Data

Data are expressed as mean standard deviation (SD). Differences in activity between the control group and test groups are described as fold changes. Statistical differences between groups are expressed with p values, where *$p<0.05$ is defined as statistically significant, and **$p<0.01$ as statistically highly significant.

Results of Cisd2 Experiments

The results of Cisd2 luciferase reporter gene assay are shown in FIG. 1. Among 10 strains of lactic acid bacteria numbered A to J, HEK293 cells treated with the active substance of bacteria A, C, H and I exhibit greater fluorescence intensity than the control group. These results suggest that the active substance of bacteria A, C, H and I may increase Cisd2 gene expression levels. Regarding the results of bacteria A, the luciferase expression levels are higher than those of the control group when HEK293 cells are stimulated either at a concentration of 12.5 μg/ml or 25 μg/ml. These results indicate that the active substance of bacteria A may increase Cisd2 gene expression levels. Regarding bacteria C, the results are similar to those of bacteria A: the luciferase expression levels are higher than those of the control group when HEK293 cells are stimulated either at a concentration of 0.25 μg/ml or 0.5 μg/ml. Again, such results indicate that the active substance of bacteria C may increase Cisd2 gene expression levels. On the other hand, bacteria H at 1.5 μg/ml exhibits 1.14-fold luciferase expression levels when compared to the control group. Similarly, such results indicate that the active substance of bacteria H may significantly (p<0.05) increase Cisd2 gene expression levels. Regarding bacteria I, the luciferase expression levels are higher than those of the control group when HEK293 cells are stimulated either at a concentration of 2.5 μg/ml or 5 μg/ml, indicating that the active substance of bacteria I may also increase Cisd2 gene expression levels.

Figure 3:
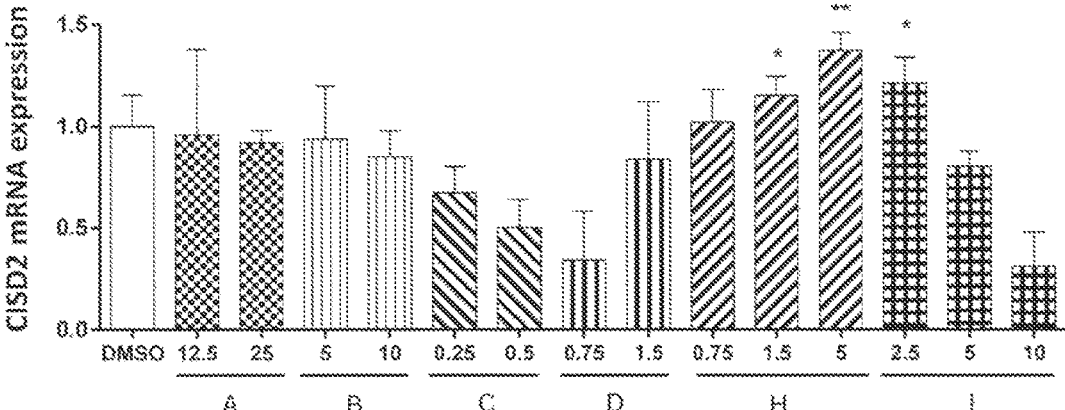
FIG. 3 shows the statistical results of the expression levels of the Cisd2 message RNA (mRNA) in FIG. 2.

The measured results of endogenous Cisd2 gene expression levels are shown in FIGS. 2 and 3. Bacteria A and C did not exhibit higher cisd2 mRNA expression levels when compared to the control group, and bacteria C even exhibits lower mRNA expression levels when compared to the control group. On the other hand, bacteria H and I exhibit higher mRNA expression levels compared to the control group. Both bacteria H, at 1.5 μg/ml and 5 μg/ml, and bacteria I, at 2.5 μg/ml, exhibit statistical significance when compared to the control group, indicating that bacteria H and I significantly raise the mRNA expression levels of Cisd2 gene. Specifically, bacteria H resulted in 1.15-fold mRNA expression levels (p<0.05) at 1.5 μg/ml, and 1.37-fold expression levels (p<0.01) at 5 μg/ml when compared to the control group. The mRNA expressions levels increase when the concentration of lactic acid bacteria active substances increases, showing a concentration-effect relationship. Finally, bacteria I at 2.5 μg/ml resulted in 1.21-fold expressions levels (p<0.05) when compared to the control group.

The above results proved that the active substance of certain lactic acid bacteria (preferably *Lactobacillus paracasei, Lactobacillus plantarum* and *Bifidobacterium*) increased Cisd2 gene expression levels and thereby may extend longevity, which could provide a novel pharmaceutical use of lactic acid bacteria. In view of the above, a composition containing lactic acid bacteria active substance is manufactured for a novel application. Additionally, an effective amount of the composition is determined to be administered to a subject to achieve a desired effect.

In the following experiment, bacteria H (GKM3) is used to determine its effect on delaying aging and promoting longevity. Bacteria I (GKK2) and bacteria A (GKS6) will be claimed in other applications, respectively.

Aging Evaluation in Experimental Animals

The general procedure of the animal experiment in the present invention is shown in FIG. 4. The animals selected to be used in this experiment are senescence-accelerated mice (SAM) developed by Kyoto University (Japan) through a program of selective breeding of AKR/J sibling matings. The SAMP8 mice used in this experiment are characterized by cerebral neuron loss, cerebral atrophy, lipofuscin deposits, cavernous malformations in reticular formation of brainstem and amyloid protein deposits. Other characteristics include rapid aging of other organs and shortened life span, which makes them an ideal experimental animal model for studies related to delayed aging and reproductive functions. These mice were housed in a 30(W)×20(D)×10(H) cm³ transparent plastic cage in a dust-free, automated room with a temperature of 25±2° C. and a relative humidity of 65±5%. Light cycle was controlled by an automatic timer, with a dark period set from 07:00 to 19:00 and a light period set from 19:00 to 07:00.

This experiment was designed in accordance with "Regulations and Evaluative Methods for Health Foods of Aging-Delaying and Health-Promoting Functions." Three-months old male and female SAM-P8 mice were used as experimental animals. The mice were first divided into a control group and two test groups (high- and low-dose groups treated with lactic acid bacteria H), and each group was then divided into female and male groups, resulting in a total of 6 groups with 10 mice per group (60 mice in total). The mice in the control group were tube-fed with ddH₂O samples, while those in the test groups were tube-fed with ddH₂O-dissolved freeze-dried powders of lactic acid bacteria H (GKM3), which were prepared at desired doses, respectively. Groups and the dose used in the respective group are shown in Table 5 below.

TABLE 5

| Group | Sample (Lactic acid bacteria H, GKM3) | Dose |
|---|---|---|
| Control group | ddH₂O | 10 ml/day |
| Low-dose group | Lactic acid bacteria H | 1.02 × 10⁹ cfu/kgBW/day |
| High-dose group | Lactic acid bacteria H | 5.1 × 10⁹ cfu/kgBW/day |

The experiment was carried out over 13 weeks, during which each group was tube-fed with respective samples once a day. Food and water intake of each group were recorded during the experiment. At week 12, the mice were assessed by means of aging score and were given a single-trial passive avoidance test. At week 13, the mice were given an active shuttle avoidance test. After the tests, the mice were subject to $CO_2$ asphyxiation and sacrificed by decapitation (fasted for 8 hours before sacrifice). Blood and organs of the decapitated mice were collected for analysis.

Aging Score

The grading score system was devised in 1981 by Takeda and other scholars for measuring the frailty level of SAM mice. To measure the aging level of the mice used in this experiment, six measure items were selected as follows: hair glossiness, hair coarseness, loss of hair, skin ulcers, periophthalmic lesion, and lordokyphosis of the spine. The aging level of the mice was graded on a scale of 0 to 4. The score obtained for each item was added up and resulted in a final score. Mice with a higher score exhibited a higher aging level.

Forearm Grip Strength Test

Aging may cause degenerated physiological functions or multiple chronic diseases that lead to accelerated muscle disuse atrophy. Typically, people lose 1-2% of their muscles per year after age 30, and dramatically decreases as much as 15% per year after age 60. The loss of muscle biomass is a risk factor that may lead to subsequent negative health events, including disabilities, falling, function degeneration, being bedridden and even death.

Aging-induced skeletal muscle loss may develop sarcopenia, which is also called "skeletal muscle aging" or "senile skeletal wasting." Sarcopenia exhibits three major symptoms: (1) low muscle mass; (2) low muscle strength; and (3) low physical performance. In 2010, European Union Geriatric Medicine Society (EUGMS) developed and published diagnostic criteria and a definition of aging-induced sarcopenia: persons over 65 years of age with a gait speed of less than 1 m/sec, poor grip strength and a muscle mass smaller than a critical value will be diagnosed as having sarcopenia. The data collected from the internal medicine and family medicine division at National Taiwan University Hospital showed that the prevalence of sarcopenia increased from 18% to 64% among middle-aged men, and 9% to 41% among middle-aged women, as their age increased. Clinically, the worsening of sarcopenia and muscle weakness can be delayed by implementing effective interventions and diagnostics to prevent subsequent negative health events from occurring.

In the mice experiment, a Grip Strength Meter (GSM, Cat. No. 47200) was used for measuring the forearm grip strength of SAMP8 mice to determine their muscular strength. The method was carried out by holding the animal by tail and causing it to grasp the pull bar with its forepaws. The animal was then pulled back horizontally on its tail until its grip was released. The force applied at this point was recorded using the GSM for three consecutive times, and the highest value recorded was chosen and analyzed statistically.

Single-Trial Passive Avoidance Test

The effects of lactic acid bacteria on the learning and memory in mice were measured by way of classical conditioning and the animal's preference for darkness. A special box divided into a light chamber and a dark chamber by a central gate was used for this experiment, with the chambers being designed to be connected to each other, and an array of parallel metal rods connected to a power supply being placed on the bottom of the box. At the start of the test, the mice were placed in the light chamber with the gate opened to allow for exploration. The gate was closed as soon as the mice entered the dark chamber, and the mice were then given an electric shock (0.5 µA, 0.5 s) once to be trained for learning. 24, 48 and 72 hours after the end of the training, the mice's memory was measured by recording the latency time in the light chamber. The maximum duration time is set for 180 s. A longer latency time in the light chamber indicated a better learning and memory.

Active Shuttle Avoidance Test

The effects of lactic acid bacteria on the learning and memory in mice were measured by way of classical conditioning and the animal's avoidance from light and sound stimuli. A special box divided into a light chamber and a dark chamber by a central gate was used for this experiment, with the chambers being designed to be connected to each other, and an array of parallel metal rods connected to a power supply being placed on the bottom of the box. All mice were given light and sound stimuli for 10 s (conditioned stimulus, CS), and were further given an electric shock (unconditioned stimulus, UCS) for those showed no avoidance from the CS. However, for those who avoided the CS, the electric shock was not given. The experimental animals were given the above avoidance test with CS/UCS for 4 consecutive days, 4 times per day and 5 rounds each time. This test aims at determining the learning and memory in mice by measuring the times they would exhibit avoidance under such test conditions. A higher active avoidance time indicated a better learning and memory.

Statistical Methods Used in the Animal Experiment

The data collected from this study were analyzed using SPSS statistical software. The results Obtained were expressed as mean±SEM and analyzed by one-way analysis of variance (one-way ANOVA) to test for differences among multiple test groups. Differences between pairs of groups were measured using Duncan's Multiple Range test. $p<0.05$ indicates a statistically significant difference.

Results Obtained from the Animal Experiment

Results Obtained from the aging score test for each group are shown in Tables 6 and 7 below:

TABLE 6

| Aging scores of female mice | | | |
|---|---|---|---|
| Item | Control group | GKM3-low dose | GKM3-high dose |
| Skin | | | |
| Glossiness | 1.00 ± 0.00 [a] | 0.60 ± 0.16 [b] | 0.00 ± 0.00 [c] |
| Coarseness | 0.90 ± 0.10 [a] | 0.10 ± 0.10 [b] | 0.00 ± 0.00 [b] |
| Hair loss | 0.50 ± 0.17 [a] | 0.20 ± 0.13 [b] | 0.00 ± 0.00 [b] |
| Ulcer | 0.00 ± 0.00 | 0.00 ± 0.00 | 0.00 ± 0.00 |
| Eye | | | |
| Periophthalmic lesion | 1.50 ± 0.22 [a] | 0.90 ± 0.10 [b] | 0.60 ± 0.16 [b] |
| Spine | | | |
| Lordokyphosis of the spine | 1.00 ± 0.00 [a] | 0.50 ± 0.17 [b] | 0.40 ± 0.16 [b] |
| Total | 4.90 ± 0.23 [a] | 2.30 ± 0.37 [b] | 1.00 ± 0.26 [c] |

Values were expressed as mean ± S.E.M. and analyzed by one-way ANOVA. (n = 10)
⋅X⋅Same superscript letters indicate no statistically significant differences between groups.

TABLE 7

| Aging scores of male mice | | | |
|---|---|---|---|
| Item | Control group | GKM3-low dose | GKM3-high dose |
| Skin | | | |
| Glossiness | 0.50 ± 0.17 | 0.20 ± 0.13 | 0.20 ± 0.13 |
| Coarseness | 0.80 ± 0.13 | 0.30 ± 0.15 | 0.30 ± 0.15 |
| Hair loss | 0.20 ± 0.13 | 0.00 ± 0.00 | 0.00 ± 0.00 |
| Ulcer | 0.00 ± 0.00 | 0.00 ± 0.00 | 0.00 ± 0.00 |
| Eye | | | |
| Periophthalmic lesion | 0.80 ± 0.13 | 0.40 ± 0.16 | 0.20 ± 0.13 |
| Spine | | | |
| Lordokyphosis of the spine | 0.70 ± 0.15 | 0.40 ± 0.16 | 0.40 ± 0.16 |
| Total | 3.00 ± 0.33 [a] | 1.30 ± 0.26 [b] | 1.10 ± 0.35 [b] |

Values were expressed as mean ± S.E.M. and analyzed by one-way ANOVA. (n = 10)
⋅X⋅Same superscript letters indicate no statistically significant differences between groups.

In view of the aging scores obtained from the test at week 12, both 3-months old female and male SAMP8 mice fed with high- and low-dose lactic acid bacteria H (GKM3) exhibited significantly lower scores than control groups. Female mice, in particular, exhibited a more significant reduction (p<0.05). Higher aging scores (as shown in Tables 6 and 7) indicated higher levels of aging. These results show that feeding SAMP8 mice with lactic acid bacteria H (GKM3) samples may help lower aging scores. Thus, it is clear that lactic acid bacteria H (GKM3) are useful in preventing aging.

Figure 5:
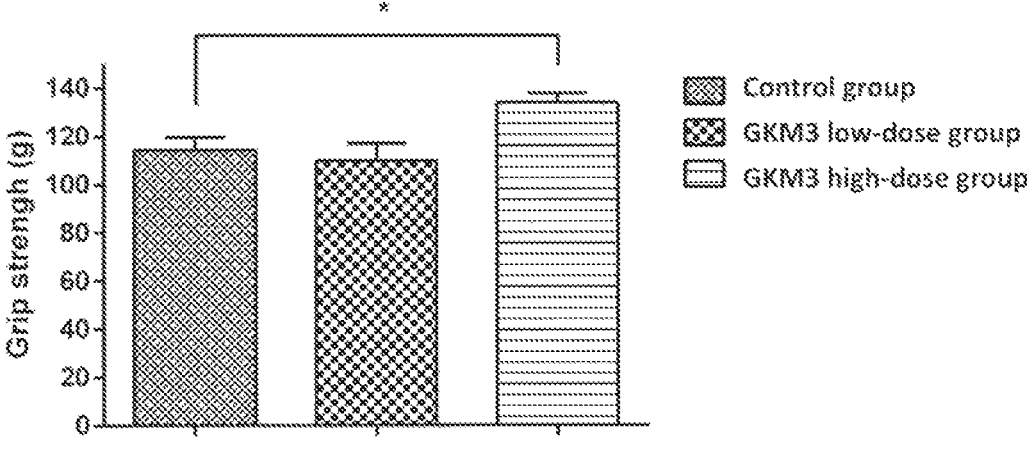
FIG. 5 shows the grip strength exhibited by the male mice during the forearm grip strength test.

The results obtained in male mice groups from the forearm grip strength test are shown in Table 8 and summarized statistically in FIG. 5:

TABLE 8

| Forearm grip strength test in male mice groups | |
| --- | --- |
| Group | Grip strength (g) |
| Control group | 114.4 ± 5.43 |
| GKM3-low dose | 109.98 ± 7.11 |
| GKM3-high dose | 133.98 ± 3.96* |

Values were expressed as mean ± S.E.M. and analyzed by one-way ANOVA. (n = 10)
*Indicates statistically significant differences (p < 0.05) compared to control group.

In view of the grip strength values obtained from the test at week 13, both 3-months old female and male SAMP8 mice fed with high-dose lactic acid bacteria H (GKM3) exhibited significantly higher values (p<0.05) than control groups. Higher grip strength values indicated greater muscle strength. These results show that feeding mice with lactic acid bacteria H (GKM3) samples may help improve muscle strength. Thus, it is clear that lactic acid bacteria H (GKM3) are useful in alleviating aging-induced sarcopenia.

Figure 6:
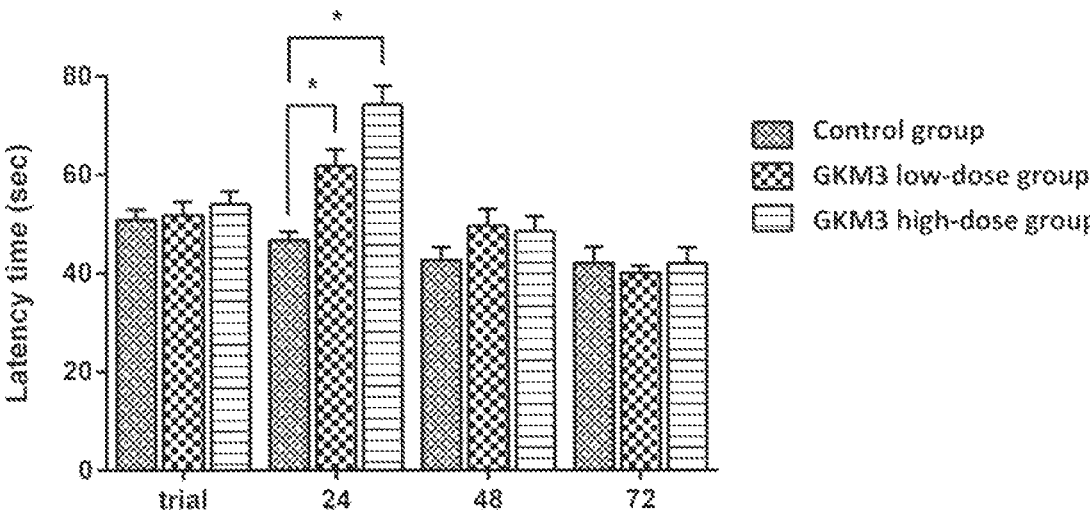
FIG. 6 shows the latency time exhibited by the female mice during the single-trial passive avoidance test.
Figure 7:
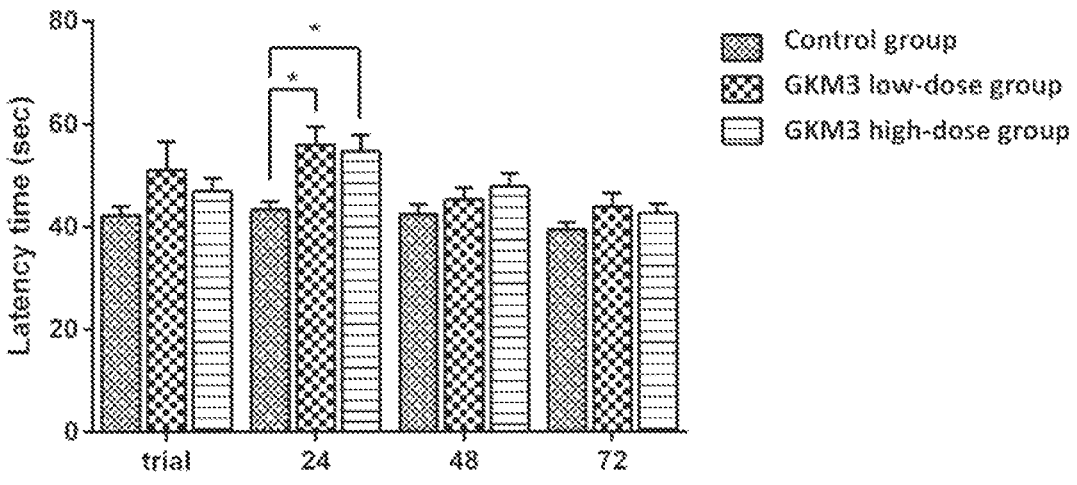
FIG. 7 shows the latency time exhibited by the male mice during the single-trial passive avoidance test.

The results obtained in female mice groups from the single-trial passive avoidance test are shown in Table 9 and summarized statistically in FIG. 6, while the results of single-trial passive avoidance test in male mice groups are shown in Table 10 and summarized statistically in FIG. 7:

TABLE 9

| Single-trial passive avoidance test in female mice groups | | | | |
| --- | --- | --- | --- | --- |
| | | Latency time (sec) | | |
| Group | trial | 24 hr | 48 hr | 72 hr |
| Control group | 50.80 ± 1.99 | 46.60 ± 1.85 | 42.60 ± 2.72 | 41.90 ± 3.31 |
| GKM3-low dose | 51.80 ± 2.67 | 61.70 ± 3.35* | 49.60 ± 3.39 | 40.00 ± 1.31 |
| GKM3-high dose | 53.90 ± 2.65 | 74.10 ± 3.93* | 48.40 ± 3.15 | 41.80 ± 3.28 |

Values were expressed as mean ± S.E.M. and analyzed by one-way ANOVA. (n = 10)
*Indicates statistically significant differences (p < 0.05) compared to control group.

TABLE 10

| Single-trial passive avoidance test in male mice groups | | | | |
| --- | --- | --- | --- | --- |
| | | Latency time (sec) | | |
| Group | trial | 24 hr | 48 hr | 72 hr |
| Control group | 42.20 ± 1.78 | 43.30 ± 1.51 | 42.30 ± 1.93 | 39.40 ± 1.28 |
| GKM3-low dose | 51.10 ± 5.56 | 55.90 ± 3.54* | 45.20 ± 2.30 | 43.80 ± 2.67 |

TABLE 10-continued

| Single-trial passive avoidance test in male mice groups | | | | |
| --- | --- | --- | --- | --- |
| | | Latency time (sec) | | |
| Group | trial | 24 hr | 48 hr | 72 hr |
| GKM3-high dose | 46.90 ± 2.54 | 54.60 ± 3.25* | 47.70 ± 2.45 | 42.60 ± 1.77 |

Values were expressed as mean ± S.E.M. and analyzed by one-way ANOVA. (n = 10)
*Indicates statistically significant differences (p < 0.05) compared to control group.

In view of the latency time obtained from the test at week 13, both 3-months old female and male SAMP8 mice fed with high- and low-dose lactic acid bacteria H (GKM3) exhibited significantly longer latency times than control groups. At 24 hr in particular, mice exhibited a more significant elevation (p<0.05) in latency time. Longer latency time indicated stronger learning and memory. These results show that feeding mice with lactic acid bacteria H (GKM3) samples may help enhance learning and memory in mice. Thus, it is clear that lactic acid bacteria H (GKM3) are useful in preventing aging.

Figure 8:
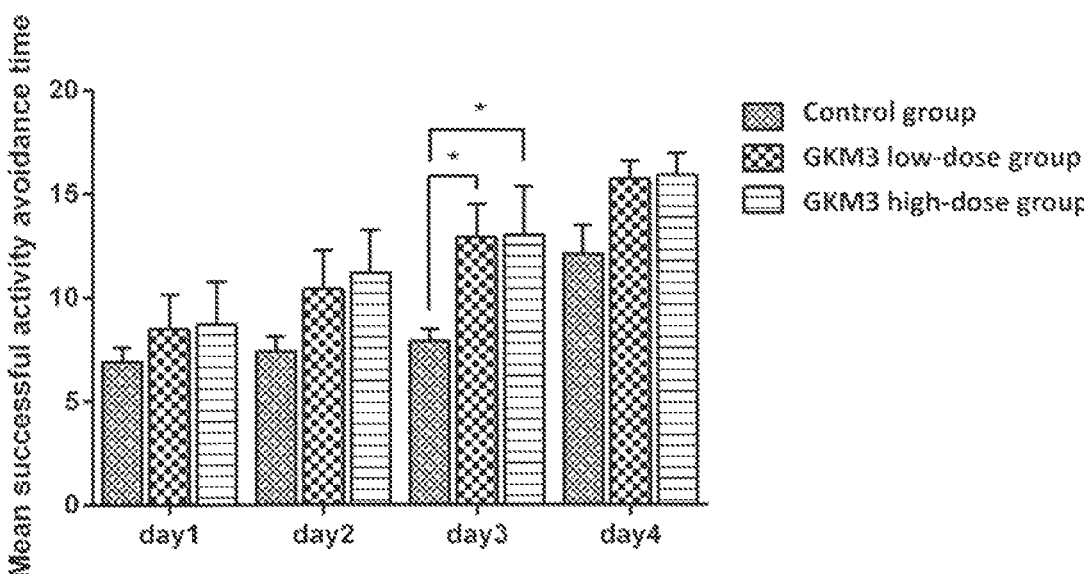
FIG. 8 shows the number of avoidance responses exhibited by the female mice during the active shuttle avoidance test.
Figure 9:
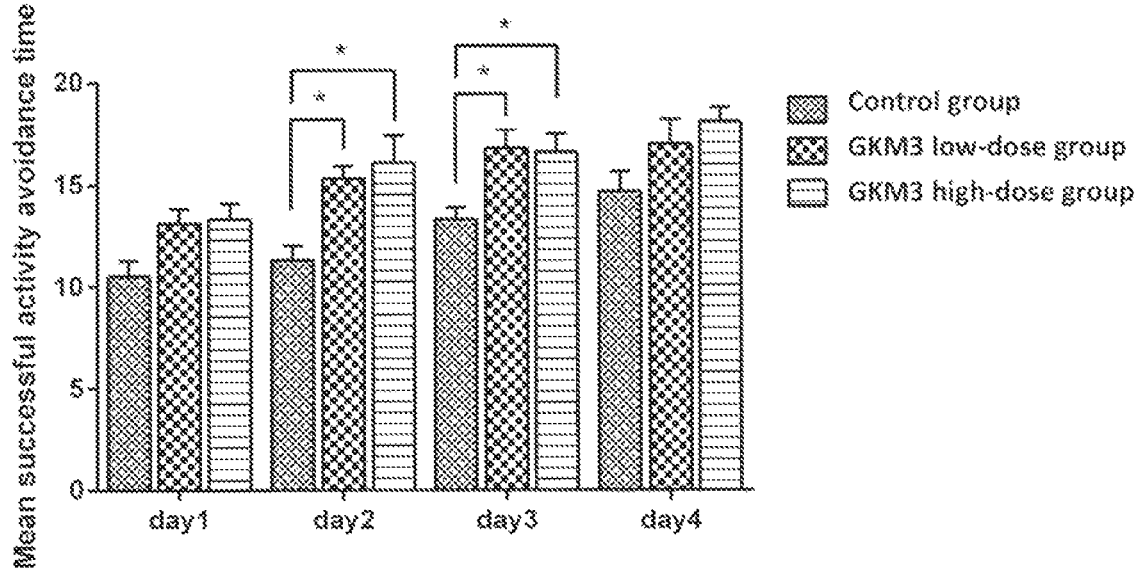
FIG. 9 shows the number of avoidance responses exhibited by the male mice during the active shuttle avoidance test.

The results obtained in female mice groups from the active shuttle avoidance test are shown in Table 11 and summarized statistically in FIG. 8, and the results of the active shuttle avoidance test in male mice groups are shown in Table 12 and summarized statistically in FIG. 9:

TABLE 11

| Active shuttle avoidance test in female mice groups | | | | |
| --- | --- | --- | --- | --- |
| | Mean successful active avoidance responses | | | |
| Group | Day 1 | Day 2 | Day 3 | Day 4 |
| Control group | 6.90 ± 0.69 | 7.40 ± 0.75 | 7.90 ± 0.59 | 12.10 ± 1.36 |
| GKM3-low dose | 8.50 ± 1.65 | 10.40 ± 1.87 | 12.90 ± 1.59* | 15.70 ± 0.87 |
| GKM3-high dose | 8.70 ± 2.07 | 11.20 ± 2.04 | 13.00 ± 2.35* | 15.90 ± 1.05 |

Values were expressed as mean ± S.E.M. and analyzed by one-way ANOVA. (n = 10)
*Indicates statistically significant differences (p < 0.05) compared to control group.

TABLE 12

| Active shuttle avoidance test in male mice groups | | | | |
| --- | --- | --- | --- | --- |
| | Mean successful active avoidance responses | | | |
| Group | Day 1 | Day 2 | Day 3 | Day 4 |
| Control group | 10.50 ± 0.75 | 11.30 ± 0.70 | 13.30 ± 0.58 | 14.70 ± 0.97 |
| GKM3-low dose | 13.10 ± 0.72 | 15.30 ± 0.62* | 16.80 ± 0.89* | 17.00 ± 1.22 |
| GKM3-high dose | 13.30 ± 0.80 | 16.10 ± 1.32* | 16.60 ± 0.88* | 18.10 ± 0.72 |

Values were expressed as mean ± S.E.M. and analyzed by one-way ANOVA. (n = 10)
*Indicates statistically significant differences (p < 0.05) compared to control group.

In view of the avoidance responses obtained from the test at week 14, both 3-months old female and male SAMP8 mice fed with lactic acid bacteria samples exhibited no significant differences with control groups. This is because they were still at learning phase on day 1 and day 2 after feeding. However, female groups on day 3 and male groups on day 2 and 3 exhibited more successful avoidance responses with significant differences (p<0.05) compared to control groups. More successful avoidance responses indicated stronger learning and memory capabilities. These results show that feeding mice with lactic acid bacteria H (GKM3) samples may help enhance learning and memory in mice. Thus, it is clear that lactic acid bacteria H (GKM3) are useful in improving learning and memory that have been undermined by aging-induced nerve degeneration.

To sum up, it can be proved from the above test results that lactic acid bacteria, particularly *Lactobacillus*, preferably lactic acid bacteria H (GKM3), are clearly useful in increasing the expression of Cisd2 gene (the "longevity gene"), improving various aging scores, grip strength, as well as enhancing learning and memory. Hence, the active substance of lactic acid bacteria H (GKM3) is useful in promoting longevity.

The term "effective amount" used herein refers to an amount that is sufficient to produce said preventive and/or therapeutic effects. In in vitro cell culture experiments, the said effective amount is expressed in μg/mL and is based on the total volume of the culture medium used in cell culture. In animal experiments, the said effective amount is expressed as "g/60 kg body weight/day." In addition, the effective amount data obtained from in vitro cell culture experiments may be converted into an effective amount suitable for animals using the following formula:

I. Generally speaking (see Reagan-Shaw et al., 2008), 1 "μg/mL" (based on an effective amount calculated from in vitro cell culture experiments) is equivalent to 1 "mg/kg body weight/day" (based on an effective amount calculated from mice model experiments). An effective dose for humans can be further calculated given the fact that the metabolic rate in mice is six times as high as in humans.

II. Therefore, when the effective amount calculated from in vitro cell culture experiments is 500 μg/mL, the effective amount in mice can be determined as 500 mg/kg body weight/day (i.e. 0.5 g/kg body weight/day). Furthermore, the effective amount in humans can be determined as 5 g/60 kg body weight/day considering the above-mentioned mice-human difference in metabolic rate.

III. Given the test results described in the previous paragraph, the effective amount based on in vitro cell culture experiments is 1.5 μg/mL. As such, it is assumed that the effective amount in mice should be 1.5 mg/kg body weight/day, and the reasonably effective amount in humans should thus be 0.015 g/60 kg body weight/day.

In a preferred embodiment, the effective amount of the lactic acid bacteria active substance contained in the composition is 10 mg/60 kg-1 g/60 kg body weight/day.

The composition further comprises an additive. In a preferred embodiment, the additive can be an excipient, preservative, diluent, filler, absorption enhancer, sweetener or a combination thereof. The excipient can be selected from sodium citrate, calcium carbonate, calcium phosphate, sucrose or a combination thereof. The preservative, such as benzyl alcohol and parabens, can prolong the shelf life of pharmaceutical compositions, The diluent can be selected from water, ethanol, propylene glycol, glycerol or a combination thereof. The filler can be selected from lactose, high molecular weight polyethylene glycol or a combination thereof. The absorption enhancer can be selected from dimethyl sulfoxide (DMSO), laurocapram, propylene glycol, glycerol, polyethylene glycol or a combination thereof. The sweetener can be selected from Acesulfame K, aspartame, saccharin, sucralose, neotame or a combination thereof. In addition to the additives listed above, other ones may be selected according to actual needs provided that the pharmaceutical effects of the lactic acid bacteria active substance are not affected.

The composition can be developed into various products in the pharmaceutical industry. In a preferred embodiment, the composition is a drug, feed, drink, nutritional supplement, dairy product or health food.

The composition can take various forms to meet the subject's needs. In a preferred embodiment, the composition can be in powder, tablet, granule, suppository, microcapsule, ampoule/ampule, liquid spray or suppository form.

The composition of the present invention can be administered to an animal or a human. Provided that the effects of the lactic acid bacteria active substance are not affected, it can be made into any dosage forms and administered via an appropriate route to the animal or human depending on the dosage form.

Preparation of Composition

When the lactic acid bacteria active substance of the present invention is of dietary use, the form of the composition 1 as described below shall be an illustrative example of the lactic acid bacteria active substance.

Composition 1: Freeze-dried powder of the lactic acid bacteria H (GKM3) was used as lactic acid bacteria active substance (20 wt %), and was well-mixed with benzyl alcohol used as a preservative (8 wt %) and glycerol used as a diluent (7 wt %). The resulting mixture was dissolved in pure water (65 wt %) and stored at 4° C. for future use. The notation "wt %" refers to the proportion of the weight of each ingredient relative to the total weight of the composition.

When the lactic acid bacteria, active substance of the present invention is of medical use, the form of the composition 2 as described below shall be an illustrative example of the lactic acid bacteria active substance.

Composition 2: Freeze-dried powder of the lactic acid bacteria H (GKM3) was used as lactic acid bacteria active substance (20 wt %), and was well-mixed with benzyl alcohol used as a preservative (8 wt %), glycerol used as a diluent (7 wt %), and sucrose used as a diluent (10 wt %). The resulting mixture was dissolved in pure water (55 wt %) and stored at 4° C. for future use. The notation "wt %" refers to the proportion of the weight of each ingredient relative to the total weight of the composition.

Deposit number of lactic acid bacteria H (GKM3): CGMCC No. 14565

Deposit number of lactic acid bacteria I (GKK2): CGMCC No. 15205

Deposit number of lactic acid bacteria A (GKS6): CGMCC No. 14566

SEQUENCE LISTING (2 sequences)

SEQ ID NO: 1 - DNA, 3137761 bp, Lactobacillus plantarum (residues 1-1,568,881 of 3,137,761)
ctggaacgtaatgacttatggaatctcattaagttctctatggaacaagatctgtccaagatcacgtttcaaacgtttgtcgaaccggcaaaaccactccaactcgataaagcccaaatgacgatcgaagtcccaacacaacttcatcgtgactattgggagaaaaacttggccgcaaagttcacggacattgcgatgcaagcgactaacgagcagattcggccggtcatgataacggaagaagaacgtcagcaacttacgagagacaaggactcgcaagtgactaccggtaacgttgcgggacaacaaccaacaaccgcaactacccccacatttatgcgggaaacgaaactcaacccgaaatacacttttgatactttcgtgatcggtaaaggcaatcaaatggcccatgccgctgcgttagttgtgtcggaagaacccggcaccatgtataatccgttgtttttctacgggggcgttggtctgggaaaaacccacctaatgcacgctatcggtaacaaattgttagaaaccgatccgactagtaacattaaatatgtgactagcgaatcttttacgaatgaattaattaatgccattcaaactaaaaaacaggaggcgttccgcgaagaatatcggaacgttgacctgttattagtcgacgacattcaattttttgccaataaggaagcaactcaagaagagttcttccatacatttaatgctttatatgaagatgataagcaaatcgtgcttacatccgatcgcttaccgaacgaaattccgcaactccaagatcgcctagtttctaggtttaagtggggattatccgttgatattaccccacctgatctcgagacgcggattgctattttgcgcaataaagccgatcttgaagggatcgaaatccctgacgatacgttaagttatatcgccggtcagatcgactcaaacgtgcgagaactcgaaggtgccttagcacgagtgcaggcatactcacgactgaataattcaccgattaccaccagtttagtggcggatgcattgaagagtttgcaccttagcagtaaactatcagaggtttcgattcccgtcattcaggaaaaagtcgccaagtacttccatgtaacaatggctgaccttaagggaaagaaacgcaataaacaaatcgtgattccacgtcaaattgccatgtatttatcacgcgaactgactgaaagttcacttccgcgcatcggtaacgagtttggtggtaaggaccatacgactgtgatccatgcgcatgataaaatcactaaggcactcaaaactgatgctgaattacaaaaagccgtgggtgatttgacaggccagctcaaatcttagtgtggataaaaaaggataactcaaaaagttttccacaacttatacacatgtggaaaacttgataacgccgagtctttactcggttttccacagtacccactgctctactattactacgaacttttattattaatatatatctagtgcccgtcgctagaataaagaggggattaacttatgaaattcacgatcaatcgatctgccttcatcaaagaattaaataacgtccaacgggccatttcttcaaaaacgaccattccaattttgactggtcttaaacttgacgttaatactgacgctattaccttaactggtagtgatgctgatatttctattgaaaccaccattccagcaagtgatgacaacaatacgttagtcgttgaagatgccggttcaatcgttttacctgcccgtttctttagtgaaatcgtaaaaaaattaccagaagacaccatgactgttaacgtggtcgacggttttcaaacacaaattacttcaggagccgcttcctttacaatcaacggcttagaccctgaaaactacccacacttacctgaaattgatacgactaataccatcacgttagctggtgatgtacttaaagagttgattggtcagaccgttattgccgtttccaatcaggaaagtcggccaatcctgaccggggttcattttatcttagctaacggtgagttcttagcggtcgcaaccgattcacaccgcctaagtcaacgccggatcaagttgccagaagccaataatgccaattatgatgtaatcattcctggtaaaagtttgacagaattatctcggatgatcggcgacaataatcctgacgtgcagatgcggttatcagaaaaccaagtcctatttgtgctggggaatacgtccttctattctcgcttactcgaaggaaattatcccgacacgtcacggctgattcctaaagaatctaatacgactgttgaaatttcagcacccgcactttcagcagcaattgaacgggcatccctgttatcacacgaaagtcgcaataatgtggttcgcttctccgttaacccaacggacaaaacgattacgattttcggtaactcaccagatgtcggggaagtaacggaacaactacagcccactgatttgtcaggtgacgaacttgaaatttcgtttaacccagactacatgaaagaagcgttacgttcgtttgggcaagctatgatcaaaatctcattcacgatggcattgcgcccattcactttagtgccaactgaagaaggcgaaaactttattcagttgattacaccagttcgaacgttttaattagctgaataaatatacaattctaaataaaaggcccgcatttcaccgtgaaatgcgggccttttatgacggctaaaactagctaaagatggggcaatgaataggcaatgacgatgatgtaacttttgaagttttaacttatgcatattatattagctgctggtgaattgtcacgctaactatcgatgttgccccactaaaatcccaccatctgatgaaccccagtccttgcactcgttcgctacaaacgctcgctttcagataatgaatgctggctttagccaatttttataggtaaaaaacaagatattttattaaaatccgcaaaattagggaatttcagcaaatttacccctaggctagtatcccgatattaaaaagccctaaatcgtcttaaaatggctctgagtgcggttataaattgaattttcatcaaaaaacaagtataatataacctgttaggagtgtgtgtagcacgccagacagtcgtttaatagcttgtaatcagataggcaggtgacattgtgaaacagccaatagatattaaaaccccatatatgacgttggggcaactcttaaaagaaacggccatcattggatcgggtggtcaggcgaagtggttcttaaaagaaacaaccgtgttagttaatggtgaaccagatgatcggcggggtcggaaactttatccaggcgatacgattgaagttgaagacaacgggtcattttttattcgctcaaatcaagaaacgactgattagatgtacttagaaaacttagtcttgcatgattttcggaactacgcggatttgaccattaattttagtcagggcgttaatgttctattaggtgaaaatgcgcagggaaagacgaacctgttggaagccatttatgtgttggcgttaacgcgtagtcaccgcaccgctaacgataaggaattaattcggtggcaaaccaccacggcaacgttgcaaggccggttacataaaagtaccggtgctgtccccttggaacttgaattggggcggcggggcaagcgagcgaaagtcaatcatcttgagcaagccaaattatcccagtacgtcggaaatttgaacgtgatagtgtttgcacctgaagatttatccatcgttaaaggggcacccgcggttcgccgtcggtttatggatatggaatttggtcagatgagccctaaatacctctataacctaagtcagtatcgcacgattttaaaacaacgtaatcaatacttacggcaattaaatcggcagcaggccaaggataaggtttatttgggtgtcttgtcggatcaattggctgcatttggtgcggaaatcatccataaacgactacaactgttgcagcaacttgagaaatgggcgcaagctgttcacagcgagattacgcaagaacaggaacaattaacgtttcactatgttactcaagtgccaactgccgaccagacgtcggtcgatcacatttatcaaacgctacaggccttatatcagcaacaacaagccaaagaaatttttcaagggacgactttattaggtcctcatcgcgatgatttacaatttggtgttaacggcaaaaatgtgcagacttttggctcccaaggccaacagcgtacaactgctttgtccgttaagcttgctgaaattgatctgatgaaagctgagacgggcgagtacccggtcttattattagacgatgtcttatcagaattagacgctgcacggcagactcatctgctgacagcgatccaagataaagtgcagacctttttaaccacgccaagtcttgacggggtggcccgcaaattaattaatgcgccaaaagtatttgaagttagccatggcactttacatgaggaggaaccgcattgaccgaaaacgaaaaagaaaccaaacttgaacaggctcgcgaatatgatgctagtcaaattcaagttttggaaggtttagaagctgtccggaaacgtcccggaatgtatatcggtacgacgagtagccaaggactccaccacttagtttgggaaattgttgataacggaattgatgaagccctagcagggtttgcaaacgtgatccacgtgaccgttgaaaaggataatagtattacggttactgataacggtcgtgggattcctgttgatattcaagaaaaaacgggtaaaccagcgcttgaaacggtttatacgattttacatgccggtggtaaattcggtggtggcggttataaagtctctggtggtcttcacggggtcggggcttccgttgttaacgccttatcatcgaccctggacgtcaaagtaactcggaatggtcatgtttattacatggactttgaacgtggaaaggttaaaacaccgatgaagatcattggtgatgcgcctgatgatgctcatggtacggcggttcattttgttccggatcctgatattttccgggaaacgaccacctatgacattaatattttgacgactcggattcgcgaactcgctttcttaaataagggattacggatcacgattcgggataatcgccctgatgaacccactgaagatgactttctctacgaaggtgggattcgtcactatgttgaatatctagataagaataagaccgttctatttccagaaccgatttatgtggaaggggaacagaatgggattacggtagaagttgcgttgcaatatactgacgactaccacagtaatttgatgaccttcaccaacaatattcatacgtacgaaggtgggacgcatgaagaaggtttcaaacgtgctttgacgcgggtcatcaacgactatgctcgtaagaataacttgttgaaggaaagcgatgcgaacctatctggcgaagatgttcgtgaagggatgacggctgttgtcagcgtcaagcatccggatcctcaatttgaaggtcaaacgaagacgaaacttggtaattccgatgctcgggcagcagttgaccggttattctcagaacactttagcaagtacttgatggaaaacccaagtgttgcccgtaaagtggtcgataaagggttacttgcttccaaggcccgggtcgctgctaagcgtgcgcgggaagttacgcgaaaaaagagtggcttggaaattagtaatttaccaggtaagttggcggacaacagtagtaaagaccctgaaattagtgagttgttcattgtcgaaggggattctgccggtgggtcggctaagcagggacgttcccggttgacgcaagcgattttaccgattcggggtaaaattttgaacgttgaaaaggccagcattgataagattttagccaatgaagaaatccggtcattgtttacggcaatgggaactggcttcggtggtgacttcgacttgagcaaagccaattatcacaaattaattatcatgactgatgccgatgtcgatggggcccatattcggaccttgttattgacgttgttttaccggtacatgcggccattagttgacgctggctttgtgtacatcgctcaaccaccgttgtaccaagtccggcaaggtaaatttgtgaagtatattgattcagatgaagaattgagtgaggtcatggggcaattggcaccatcaccgaaaccagttgttcaacggtacaaggggcttggtgaaatggacgcggaacaattatgggaaacgaccatggatccagacaagcggcgcctattacgggttcgtgatgaagacgctgcggatgccgatggggtcttctcgatgttgatgggggaccaagtcaaaccacggcgagaatttattgaagataatgccaagttcgtccaggatctggatgtttagtgtgtcagtttagtcattttgacctaagaactgaggcgcaagctgttaatcagacttagggtcgtaatggcacgacggttgtcttaatggcgacttttacttgagacatgtaaagcttaatcaagctttaatagcggcaaaacggatgaaggaggacgaatattttggctgattcagatttatcgaacaatcgtatttcggatgtgaacctttcgaagaccatgcgaacgtcattcttaagctatgccatgagtgttatcgtggcacgggcactgccggacgtacgtgatgggttaaagccagtgcaccggcggattctttacggtatgagtgaattaggtgtgacgccggataagccgtataagaagtcggcccggattgttggggatgttatggggaagtatcatccccatggtgactccgcaatttatgagtcaatggtgcggatggcccaagactttagctatcgctacatgttagtggatggtcacgggaacttcggttctgtcgatggtgacggggctgccgcgatgcggtataccgaagcccggatgagtaagattgcggttgaaatgctccgcgatattaacaaggataccgttgattggcaaccaaactatgatgatacagaacgggaaccagcagtcttaccagcacgtttcccgaacttactcgttaacggtgccactgggattgctgttgggatgacaacaaacattccgccacataacttagcggaagtcatttcagcaatccacctgttgatggataatcctgatgcaacagttgctgacttgatggaagtcttacctggaccagattttccaactggcgggatcgtaatgggaaagtccggtattcgtaaggcttaccagactggtcgtgggaacattattgttcgtgcgaaggtcgatattcaagaccaaaagaatggtaagcaacgaattatcgtgaccgaattaccatatatggtcaataaagctaaattgatcgaacggattgctggtttagctcgagacaaggaaattgaaggtatcactgatatcaatgatgaaagtgaccgtgaagggatgcggatcgtcattgatgttcggcgggatgccagcgcctcggttatcttgaataacctttacaagatgacattgatgcagactaactttggctttaacatgttagccatcgttaagggtgctccaaaagtcttaagcttaaagcaaatcttaatctattacctggaacaccaggaagacgtgattcggcgtcggactgagtttgacttgaagaaagcccaagcacgggtccatattcttgaaggcttacggattgcccttgatcacattgatgaaatcattgcgattattcgtcaatcacaaacgagtgaaattgcgaagaaccaattgatggataattacggcttgtctgataagcaggcacaagccattcttgatatgcggttagtccggttaactggtttggaacgtgaaaagatcgagagtgaataccaggacttattgaaagccattgctgactacaaagaaatcttagctagcaaggatcgtatcaaccaaattatttacgaagaattaatggaaattcaacgtaagtttggtgataagcgtcggaccgaattgatggtcggtgaagtcctcagtattgaagatgaagacttgatcgaagaagaagaagtggctgttaccttaactcacaatggctacatcaaacggttaccaacgactgaatttaagtcgcaacaccgtggtggtcgtgggattcaagggatggacgtccatgatgatgactttattgaacatctcctgacgacgtcgacccatgatgtcctactctttttcactaatgcgggtaaagtttaccggatgaaggcttacgagattcctgaatacggtcgtacggccaaaggaatcccggtcatcaatttactgggagtcaattctggtgaaaaaattcaggcggtcgttaatgtcacgggcgatgcgagcgcttctgataactacctgttctttacaaccgttaaaggggttgtcaaacggacaccagttcaagaatttgccaatatccgtagcaatggtttgaaggccattacgcttaaggatgatgatgaattaatcggggttacaatcacggatggtcaccaaaatgtaatcatcgggacgcacgacggttatgccgtcagtttcgacgaaaccacagtgcggtccatgggccggacggcttctggggttcgcgggattcgcttacgcgatgatgactttgtgattggctttgacgttttgaagcccgacagcaacgtcttcatcatcacggaaaagggttatgggaaacaaacgccagctgccgattacccaattaaggggcgtggtggcaaaggaatcaagaccgctaacgtgactgagaagaatggtcatttagctggtttgacgacggttgatggtcaagaagatatcatggtaatgacgaaccaaggggtcatgattcgcttcaatatcgcaaccgtttctcagactggtcgggcaaccttaggtgttcgtctcatgcggttaggcgatgatggtcaagtcgcaacgatggccaaggttgatccagagccagaagttgatgagactgtcgcaacggatgcaacgactgaggcaccagttgacgatcaaaccgtcaacgccgatgccactacgacagaaccaacaactgattcaaacgattcaaacgaataaattgataaaacaagcgtggtcgacaagattgtcgaccacgcttgttttttatgtgagtcaagaattattatggcaacgggtcgtgtgtgatttaccggtcatcggtcctattctggcctccaaagtcttgttttgaaccggtagaaacaatcttcctgcgaagaataatttgactgctggaggctcattacttagtcctgccatcttccagtgattggcagaaatgccgataaattgggagaggacaacatgaagtaagcaattttagatttacgcggtcaaaactggcttgtgcgattgagaggattacagcagtgcgtgttattctgacgtcgacttggtttaaattaatgctgtgtgggtgtggggaaatgtaagcgaaggggaggatttcagaaaaaagaaatatttcccgggaaataaaatgaaatatcgctcaattgacgtaattgattggtgtaacggattcaggatctttttgtaacagtcggccgcttcaacccttgcaacaaactgatttagatgctatactttaaattcgtgagtatctagcattagctagattactttccttgctcttcaaaaagaagggcctgaagtccataaggaggtgcaaatttcatgagtgaatcaaagaaatatgaaattacttacatcgtacgtcccgacatcgacgatgctgccaagacagccttagttgatcgtttcgacaaaatcttaactgataacggtgcgcaagtaattgattcaaaagactggtcaaagcgtcgtttcgcatacgaaatcggtggctttaacgaaggtacttaccatatcgttaacttaacagcaactgacgatgctgctttaaacgaattcgaccgtctttcaaagatcaatgatgacattttacgtcacatgatcgttaaacgcgaagactaatagacaaaattaattttaagagaggagcgcttctgcatgattaaccgtacaattcttgttggccgactgacaagagatccggaattacgttacacgaatggtggtgccgccgtcgcgacgttcactattgccgtaaaccgtcaattcacgaatcaaaatggggaacgtgaagcagatttcattagttgcgtcatttggcgtaaagctgctgaaaattttgcgaactttactcataaaggttcacttgttggtatcgatggccggattcaaacccggaactacgaaaaccaacaaggggtacgtgtttacgttacagaagttgtcgttgaaaacttctcattattagaatcacgggcagagtctgaacgtcatcagtctgccaatggtggtagtggtaataacaattacaacaacaataataatgggtatagtaatcaaggccaaaatgcggctcctcaacaatcatcagcgaataacaataacccatttggtaatggtaatactggtaatgctagcagtgcggcaccatcaagcagtgctaacaacaataatcaggctgacccattcgctaataatggcgatcaaattgatatctcggatgatgatttaccattctagtctaattgcttagacagataacgaggagggaaatatcaatggcacaacaaagaagaggtggccgtcgtcgtcgtaaagtcgacttcatcgccgcaaaccatatcgaatacatcgattataaagatactgacttattacgtcgctttatttcagaacgtgggaagattttgccacgtcgtgtaacggggactagtgctaagaaccaacgttctttaactatcgccatcaagcgtgcacggatcatgggcttattagcctttgtatctgaagactaatttttagtcattcaaaaaccacagacttcggctctgtggtttttatttacccttaacttgactagatagggtggtggccgttcaatgaagcgtttacggtgattgacacgaaacgctgaagcggacggtggtttgtgataaaatatagtcattactgagaaggcttgagggatttttaatatgaaaaagatcttttcgcgtgaaaaaattccatttttcctacaaaatcagcagttacgactcttagcgttggttatttttagcttgtcgttaattatgctcgtcactggttatttaatgaactggatttttgggaccgttgtcctcatcttgattgtgatggctgtggtgatatcttataatacgttgattgagctcagttcgagtgcaaatgaatatatctcagacttgtcgtatcgtattaagcgcggcgaacaagaggcactgattcagatgcctatcggagtaatgatttttaattccgaccagaccatcgaatggatcaatccttatcttcagcgctatttcggtgataaggacgtcttaggataccgcttggaagatattgagccaacactggcagcgacgctgaacgctcatctggacgagcccgcgacgattcgttggcaagactaccagtttgatgtacgtgtccagcagagcactaatacggtctatatgatggatgtgaccaagtatgctgagctgacggatcaattcgaagatgaaaaactcgtgattggacaaatctttttggataattacgatgaaatcacccagtcgatgactgatacggatatttccaacctgaacaattacgtgaccaatgaattgtctaagtggacccagatgtttgggatgtacctgaagcgcttggatgatgatcacttcttcttgttgggctatgctagtagtttacgacgtgttgaagagaataagtttcgcattttagatcgaattcgggagtcgacttctaagcaaaatttcccactaacattgagtattgggattgcttatggtgaacggaacatgaacaatttggccgatttagcgcagagtaacatggaccttgccttggggcggggtggtgaccaagttgtggtgaagtctgaggacgaacctgctcgtttctacggtggtaaaaccaacccgatggaaaaacggacgcgggtacgggcccggatgatcagtcagacgttacaagagttaatgaatcaatctgaccagatctttgttcaggggcaccgccaaccagatatggatgccgttggggcctgtctcgggattcgccgaattgctgaaatgaatggtaaacagtgttggatcgtcttggatgagcaaaatgtgcattcagacattcagcgtttactggaccagttgaagtctgatgagaacatcgagtcatcgattatctcgccggaagaagcacttgagaaggccactgaccaaagtttattgattatggctgaccattctaagccaagtatttcaatgtcacaggccctttatgagcggctcgaaaatcgcgttatgattattgatcatcatcgacggggcgaagaatttccagaaaacccagttttggtttatattgaaccgtatgcttcgtcgacttgtgagctgattaccgagatgtttgaatatcaatcgcacgatgccgaaccaatcaataagattgaggcgaccgcaatgttgaccggaatcgttatcgatacgaagtcattttcattacgatcaggatcgcggacgtttgatgctgctagttatctacgatcagccggtgcggactcgttactcgttcaacaatttatgaaggagaacgttgatagttatctacaacgcaatcatctgattgaaaccgttgaatttgttaaccaggatatggcattatgtgttggtgaagatgatcaggtctatgacccagtaacggcggctcaagctgctgattcactattatctatgtctggtgtcgacgcatcattcgtgattacacgtcgtgaagatggacgggtcggaatttcggcacgatcacttggcgagatcaacgtacaagtttatatggaaaaattgggtggtggcggtcatttatcgaatgctgcaacccagattgaagggcagtcagttgaagccgtcaaacaatcgttgattgatttgttaacggcaactgatgagccgaccacagaatctaattaggagtgagtctaaatgcaagttatttttttgaatgatgtccgtggtaagggcaagcggggccaaatcaagaatgtcccggatggttacgcacagaactttttaattaaaaagggattggccaaggaagccactaaagcggcaatcaatacgttgaaggctgaacagaagtctgaagcagcacgtgccgctgaggaattagccgaagctaagcaagtcaagacagttttggaagctgatgaaacggttgttgaattgaaggccaaagctggtactgatggtcggttgtttgggtcaattcctagcaaacaaattgcaacggcgttagctgaccaataccaagttaagcttgataaacgtaagatcgaattaccagaaccaattcgggtattaggttacacaaacgtgcctgttaagttacatccagaagtaacggcgaaaattcgcgtgcacgttgtcgaaaagtaaaaggacggatcacaaatgaacaacgatgtgctggatcaaaccccaccacaaaatattgaagctgaaaaggcagtcttgggggctattttcttaaacagtgatgccctcgtggaagcgatggagtttgtcgaagcgcaagatttctatcggcgcgcacatcagatcatttttgccagcatggtgactttaaatgaccgtgacgaggctattgatgcggtgaccgttagtgatttattaacggcccaaaatcaattggatgatgttggtgggatgagttacattgctgaattagctgggtccgtaccgactgcggctaacgctggctactatgctaagattgtggcgcaaaaggcgacggtgcggcggttgatcaagacggccacggagattacgcaaaaggcctatacggaaaatgatgacgtgaccacgttattagatgacgcggaacgcgacattatgaacgtgtctgaacagcgtaatcagagtgggtttaagtcgatttcagatgtgttgaacgcgtcgattgaagaaattgaccgcttgtatcaaaatgatgatgacattaccggtttaccgactggttttgcggagctggataaaatgaccgccggcttacaaccggataatctgattattttggctgcccggccagccgttggtaagacagcctttgtcctgaatattgcccaaaatgtggcgactaaaacggatacgacagtggccattttcagtttggaaatgggtgccgaatccttagtcaaccggatgctgtgtgcagaaggtagtattgacgctgggcatttacggacggggcaactgaacgaagaagagtgggaacacttggtggttgccatggggagtttgtctaaagctagtatttttattgacgatacccccggaatcaagatgtcagaaatccgggccaaaagtcgccgcttagcgaaagagcaaggtaacctcggcttgattgtggtcgattatttgcaactgatcgaaggtagtaacacagaaagtcggcaacaggaagtttccgaaatttcgcggcaaatgaagaaactggctaaggaactaggtgttccagtcattgccttatcacagctatctcgtggtgttgaacagcgtcaagataagcggccagtgctttccgatattcgtgaatcgggttcaattgaacaagatgctgacatcgttgccttcctataccgggaagattattatgatcgcgaaggcggcgacgatgatgatggcggtaattttggtggcggtggtgactttaatggcggcgatccgcgggacgaagatgcttctgaggatgttggtgaagttgaagtgattatcgaaaagaaccgtgctggggcgcggggaacggtcaaactattatttgtgaaaccatttaataagttctcctcagtctcttatgcgcaggatccccaagcttaattgcagtcgatcaataaatttgttatcaaattcctcttaaactaattaagaggaattttttgtttatcacgtgccgaggctacttgttttccgccaattggttgggctgatgcaccaatttggccgtgataataatgagttagtgagataaatgtccctgttattttaaataaactttgctatgatgaaaagtagacagatttaataatggtggtgatggcgtggcacaaaagcaactcattaaaacgccgtggctaattgccgggcagtttatgaataacattggtatgagtttcatttggccgttaacgacgatctacatgcacaatgtgttaggtaagtcgttgacggagactggaattgtcctgatgctcaattcagttgccaacgttttggcaagtacgattggtgggcgtatatttgatcgaggtaatccttatcacctgttactgatgggaatcacgttgaatggcctcgcgaactttgctctgatcttttttcatggatggccgtggtatccgatgttgttagtcgtgaccgggtttgctagtggctggctaaatacgatgtttaatgctttggctgccagtgtcccccgcgataaagtgcggcgaacgtttacgttgatgtatctcgctgccaatctcggagttgtcttcggcacgatgctggttggtatcgtgtatagcatggggatggccttgctattctcgatgaccacgagcctcttcgtgattttcttgattattgcattatttgaatacaatgtggattcgtcgaacgtgaccggggttgatccgcgccaaggacaagatgtgcacttgccacgggccaattttcacattgtctggaccttctttattagtttatttattatctggttgctatacgaacagtgggtcagcaatttatccgtctacatgacgaatttggggatgccgctgcggaattacagttttctatggacaatcaacgcgggcttactggtccttattcagagtattttaagtttgctggggaatcggattaaaaatttatataatcaatttttcttcggcatgctattcgtgggcttatcatttctatcacttgtgattgcgcatgattacccacactttatctttgccatgattttattgacgattggtgaagcaacttggtcaccagccatgccaacactagtgagtcagttatcaccagttagtgctaaggggcgttaccaaggactagtacaagccttttgtgcgttagggcgctcgctagggccgttatttggtggtgtgattatcgataattggtcttataaggtgctgtttttgttggcatttgtggttttattgatcgtgttggcagttaatatcggtgtcgttcactttaatttacgcaaggccgttaattatatgaagacggacgttcagaccgatgtttcacgtgaaacaaaataattagagaagttggtggcagtagtgaaagtgatacgaaaactaaaggctaaacgagtcgtgattaaagtcgggacaagcacgctagtttatccagatggatcgatcaacttacgggcaatcgatcaattagcctttgttattagcgcaatgcgacaccgtgggcgtgaagttgtcttggtttcgtcaggggctattggtgttggcttgaattatatgggactcaagcaacgtccaaaagcaattcctgaacaacaggcgattgcggcgattgggcaaactgaattgatttcgatttacaaagaacgtttcgccatttatgaacaaaaaattggccagttgttattaacacgtgatatctttgtttatcctaagagtcaccataatgtgttgaatacatttgaggcgctattaaaacaaaacgtggtcccaattgttaatgaaaatgatacggtcgcggtcgatgaattggatcatgaaacaaagttcggtgataacgatcaactatccgcaatcgtggccacgaatatcggggcggatttgttaatcatgctatccgacatcgatggcttttatgatggtaaccccaatgcggatgcccgagcccagttattagggtacattgagaagattgatcaacatacttataagctagctggcggtagtggcagtcggtttggtactggtgggatggtcactaagctaaaagcggcagaacggatgatcgatgcgaatggtcaaatgattttagccaatggtgcggatcccacaattgtttttcaaattttagcaggcgaaccagtcggaacgctattcggttaagttggggaggttatcaaaatggtagatttagaacagttgggtcagcaggctcaacaagctagctatacgctggggttactttcaacggcgcaaaaaaatcaagtgttgaccgcaatggcaacggcgttaacgagccatcaagatgagatattggcagctaatgcgcaggatttagagaacccgcaagtaccagttaagtttgttgaccggctccggctaacagcagaccgcatccaggatatggcgaccgggctcaaacaggtcgtaagtttgccagatccaattggaaatgtggaccgcgcgtggcgcaacgaggccgggttgatgattgccaaggaacgggtaccgttaggtgttatcggcatgatttttgaagcgcgccccaatgtgacggtggatgcatcagcactgtgttttaaaaccggaaatgctgtaatcttacgtggtggtaaggaagcccttcactctaatcaagcacttgtccaagtcttacgtggtgcattacgggccgaagcggtcgatgagaatgcgattcaactgattacggatacgtcgcatgcgactgcggctaagttcatgcagctcactgattacgtggacgtcttaattccacgcgggagcgcccgtttgattcaaacggtgttggctaaagcaacggtacccgttattgaaacaggagccggtaattgtcacgtatatgtggacaaagacgcgcaattgcaaatggcaaccgatatcgtgatcaatgggaaagttcagcgaccatcggtttgcaacgccactgaaaagcttctaattcatcgtgaggttgcggccgattatttacctagcatgattcaggcacttcgtgaacaaggcgtagaagtacgcggggatgccgcaactcaagccattgttcctgatgtggttccagcaacggatgcggactggggaacggaatataatgatttaattattgcagtgaaagttgttgattcagaagcagcagccattacgcacatcaatcgttacaatacccaacattccgaagctattgtgacggataattatcaagctgggaagctcttccagcaacgggtcaacgcagcgtgtgtttatatcaatgcttccacccggtttacggatggctttgaatttgggtttggcgctgaaatcgggatttcaacgcagaagttacatgctcgcggtccgatgggattagcggaattaacatcttataaatatgtcattgatggcaatggtcagattcgccattgatgggcaagtatcgttattagtcagtatatcggctaatagcgatttttttattgccgattggggagacaagtgtttatccgatttttgacttcttgatttgataacccaacatagccggtctagttttaagctcgcgtaccatacgtctggttcaaaagcgcaagctagtttcggcctgaatagtgaaggcataataccatggtgacttagaatgctgagcgaaacttttagttgacagatgtaaacttaaaagctaatcttatcttaattagtttttaatctaaggggaggaatcatgatgatgaacgcaggattgcaaaacgttattgtagtcgtgaaaaccagtaattaccggtttaccacggataacggaggcttaccgttgatgtgttgttgtcggcgccaatcgaagtatcgttgccagtaaccgacatcatcgttaagttaggagtcatcattcatgaaaaaaagaatatggatcagcagtattgctattgtagccctaggattagtgttaactggctgcggtagccagcagagtagtcagcagaagacgttgaacgtaacggcgacccagtcgattgcgaccgctgatcctaataaggccgacgatatcgctagtcaggccgctattgctcagtttatggaaggcttgtacacaactaatcaaaaggggaaagtcgtgccggcaattgccaagaaagtcgtcaaaccgactaataatgggaagacttatacctttaatttgcggcacaatgccaagtggtcgaatggaaaaaaggtcacgggcgctgactttgtttattccgtgcaacgccaggtcgatccgaataccaagtcacaggaagtcggacacgttgctgaaatcaagaatgcaacagcaatcacggctggtaagaaggcggtgaagaccttaggcgttaaagcgttgggtaagtataagttacaaattacattgcaacagcgcgtgccgtattttaattatcggctagccacagaaatctatccgttaaataaacaatttactgagaaatacgggaataaatatgggacatcggcacagcgaacgctctctaatggtccctatgtcttgaagagttggaatgggacgaatgacacgtggaaatatgtgaagaacccgtattattatgaccgcaaacaggtccgaatcaagaatattaaggtgcagacggtcaaaaataacagtacggccgagaacctcttccaaagcaatgaggtccaagtcacccagattacgggcacccaagtatcggccgctgagcaagggtcactaaaaagtcagatgaaggttacgaagttaaatcaactctacttcatgttgtggaaccagaagcgctcagcattgcagaatactgacttgcggcgtgctgtgagttacgctttgaatcgccagtcattagttaagaacgttctcaaagacggctcagtagcggcgacgtcattagttcctgctggcaataccaagaacccgacaacggggaaagattttaatacggataccggaaacttgtatccatacagtccagcaaaggctaaacagtattggcagaaggctcaggcgagcttaggaaagcaaaagttaacactgcaattattgacgaacgataatgatattaataagtcggtggcagaatatattcaagctgcaattgagaaaaatcttagtggtgtcacggtcaatgtcaagtcagtaccactgacaaatgagatttcaactttaagcaagggtgattttgactttgccacgttgtcgtggtcgagtgatttccaagatccagttgatttcttgaataaggcttcgataactaattctgtcaactttgggaagtttaacaatgcgaaatatgagcaattaatctcgacgattacggccgataagcagtcaactaaggcccgatatcagacgatgcagcaagcggctaagctagtcgctcagcaacagggggtcacaccgatttatcaaactgctgctgctcacttgatcagtaacaaggttggtggggttcacttcacattgttgcgagacgccctttatcgctatgcctactggaagtaatcagtcagataaatattattaatttgatagaaatgtaattgaataaatcaactagcccgaaaaaacgcgttttttcgggctttttttgatgttttggcaaacggcgcaataaaacggataaccacgggcttaactgtgaatagttgtcctgaatcagtttgcagcggtctgggtgactagtcataataatcgttatcttttaggggtttgtgccctgtttgatcactaagtaaggcgaccttatcaaggataggcaaacaccctgtcaccttcttataataagattaattttataatctgctcagttaatcacatagggggtgtgatgctttggttaaacaaactacggaaatgaatgatgcaagttacttatttaataccggcgcaggatttaatagtcaggattacttaggctgtcatttgggcgcatctggtcgggcggtatttcgcgtctgggcgccgcatgctaaggctgtcggggttgttggcgattttaatgactggcaaccaagcgcactaaagttattaggggcgacggggatttggcaaggacaagttccgaacgttcatgcgggtcagttatacaagtttcagatcacaacaccaactggccaagtgcaactaaagattgacccgtttgcacaacagttcgaacgaaaaccgggggatgcggccgtagttgttgagccgatgacgatgcgttggcacgatagtttgtggctagctcgccggaagaagtcgcgcgctgccaatcggccaattaacatttatgaggtgcacttaggttcgtggcgccgtcatcttgatggtagctactacacttatgcggaattagccgctgaactgattccctatgtaaaacaacggggctatacccacattgaattaatgcccgtgatggaacatttgttagatgcgtcttggggttatcagcaattagggtattttgcgccaaccagtcgttttggcaagcgtgacagttttctcagctttgttgaccagtgtcaccaagcgaatatcggggtattcgttgattgggtaccgggtcactttattcgcaattatgatgcgttgtaccagtatgatggtacgccgacatttgaatacgctgatcctgagcgcgcgaataaccgtcgttggggggcatggaattttgatctcggtaaaacacaggttcagagttttctgatttcaagcgccgaatattggctcgaccagtgtcatctagatggcttgcgagtggatgctgtctctaacatgttgtattgcgactatgatgaagggcgcgaagggcaggttaatcagtatggggataatcgtaatttagaaggcatcgcctttttacaaaagttgaacaccacggtcttaacccaccatcccgatatcttgatgattgcggaagagtcgtccgcctatccgcaggttacgggttcggtggccaatggcggattgggatttaactataagtggaacatggggtggatgcacgataccctggatttcttcatgatggatccgttatatcggcacgaccactttaatctactgacatttgcattcgtgtacatgttcgatgaacggtttattctaccgttttcacatgatgaagtcgtgcacggcaagaaatcattaatgcataaaatgccgggggaccgctataatcagtttgcaaatttgcggacgatgctaacttatatggctgccttcccaggaaaacaactgaattttatgggctcagagtgggggcagttcctagagtggcgggactggagtgcgttggaatgggtcgacttaaaggatgatctcaaccatcggatgcaacagttcacaacgcaactgaacgcggtctatcggcacaatcggccgttgtgggaacaggaccatgatcctgcggggattatttatacacataccgatgatcctgacagttcgaccatggggtttatccggcaggccaaacggaaatacagttttgtggtcgctgctttcaattttgttcctgttgaacgtcaagattaccggatcggcgtaccgtatcgtggccgttatgagttgttactcaatactgaagcgcaggcttttggcggcacgtggacaaagctagaaacaacgtttacggcggtcgataagccgtatcgggggcaaccagctagttttaccgtgaccttgccggcgatgggtgcattgttgattcgaccagttaaagtgataggaggagttaagcatgcaagatgaaatgttagggattattttagcgggcggtcagggcacccggcttggtaagttgacgaaggatacggctaagcccgccgtgccattcggcggtcgttaccgaattattgattttacactcagcaactgtgctaactcgggtgtgaataccgttggggttatcacgcaatatcaacccctagaactgaatgcacatattggtagcggtgcgagctggggctttgatagcttaaatggtggggtgacggttttacaaccatactcgtctagtgaaggtgagaagttctttcaagggacggcgcacgccatttatcaaaatattgaatatattgatcaacaagaccccaagtacctgctcgtcttatctggcgatcatatttataagatggattatgacgctatgctgaaatatcatcaggagaagaaggcttcgttgaccgttggggtgatccacgtgactaacgaagaagccaaacgctttggcatgatgaatacggatgcgacggatcgaatcattgagtttgaggaaaaaccggaacatcctaagagtgataaagcctcgatgggcatttatatcttcaactggccgactttgcgggattacttagttaagagttatgctaccgataagtcacttgaagactttggtaaaaatgtcattccatcatacctagccaataatgaatccgtttacgcttatgcttttaagggttactggcgagatgttggaacgattaagagcctgtggcaagccaatatggaattcctatcgccccataatcggttaaatatcggcgatcgttactggcggatttactctaaagcagaggtgctaccaccgatgtttttgacggaaacgagccaagtcaataatgctatggtcgttgatagttgttacgttgcgggcgaaattgatcattcaatcttatcgcaacgcgtgtcagttgggatgggtagtcgcgtggtcgacagtatgattatgcccggtgcaacgattggaaaaaatgtggtgattgaccacgcattgattggcgaagatgcagtgattggtgatgatgcccagattattggtacgactgataagattgcagttgttgggtatcacgaaacgatgggggtggaacaaccatgagacgtgaacaagtgagtgccattattaatttactggaaccaagtgacgcgttacaaccattgaccgcagttcggccagttggaatgttaccctttggtggtcgttaccggttggttgattttcaattatcgagtgtcatcaatgcggggattcaaaatgtgatggtgacggtcccgcggtcagggcgttccgtggctgaccatttgcgtaacgggcgtgactggagcctgaacacaattcgcggcggcctattcttgtccccatacaatgacttgaatttagtggcgccagaaaagaaggccgcattactgcaccattactatgataattcgattcagtttctgaaatgcagtcagagtgagtactcggtagtgatgagtactcgcaatgtcggtaatattgatttaaaggcgctactacggtatcacgaggaacgtaacagtcccgtgacggcggtttataagcgcgttgatccagctagtttgattcccgaaaatacaatcttacaattgactgctaagggagaagcaacggcggtcgttccgatgagcaaggccaagattagcccgaagacgaaacaagttgccaagagcatggctatttacttgatgagtacggtcgatttaatcgaattattgcagtcggccaatcaacggggtgacatgatcagcctagaggaattgatgcggcaagcagtcatccaacataacgctaatgcttttgaatatacgggctttcaggcgaatattcatgatatcaacagctactttgcggccaatatggccgttttggatgaagctaatttccgagcgttattctacagttcgcgccgtatttacaccaaggtcaaaaatgaaatcccgacgttctttgcgactggttcacagtgtcgtgatagtttatgtggtactgggggctatattgaagggcaacttgaccactccgtcatctttcgggatgtactgattaatcgtgatagccaagttaaaatgccatcattatgcagggggcccggatcggtgccggttgtaagttagaaaacgtcattatcgataaagacgccgtaatcgggcccaacctagtgcttaaaggaacttcaacgacaccgttagtcatcagcaaagggcagcacgtctttcaacaagcggaggtggctgtgcatgactagggtattattcgcggcggcagaagcggcccctttttataagactggtggcttaggcgatgttagtatggcgttaccgcgcgccttgcaagcggaaggaatcgagacgcgtgtagtgattccgtattaccctcaccagatgccgaccgaatatcagcagcagttagtgccagtgacgcattttactgttcaagtgggtgaacatgcgatgtattgcggtattaaaactctgacagtcgcgcacgttcagtattatctaattgataatttagattattttggtcgtgaaggattatatggttattgggatgatggtgcacgctttgccttctttcagatggcggtttgtgaaatgatggagcggatcgattatatccctgatattttacaactcaatgattggcatacagcgtttattcctgtcttgctagctgaaaagtactattggatcgaagcgtatcgtgatattaaaacggtgctgacgattcataacttacagtttcaaggtgtctacgatccgattattttggatagtctctttcgaatcggaactgagacttacaccgaagccggcgtggcgttttacgatcaagtgaactggctgaagggcggtattaactttgcagatgccgttaatacggtgtcaccgacctacgcacaagagattcaaacaccagcttttggggaacgtctcgacggggtactgcgggccaatcggtacaaactgagtgggattcttaatggcattgatatgcaattatacgatcccgcaaccgacctggcactaacggcgaattattcggctaagaatttgaaacctaagcgtcagaataaacgtgctttacagcgccgattagggttgcctgtcaaaaacgtgccggtattggcagtcgtttctcggttaacgaagcaaaagggtatcgacctcttgctggatgcattgaatccattcttgcagcaacaggatgtgcaactcattgttttgggaacgggtgacccagcattggaacgcgcgttacgcacctatcagtcggcgtatccgcaaaaggtggtcgccgcgattcaatttgatacgcagctagctcagcaaatctatgcggccagtgatatctttcttatgccttctgcctttgaaccgtgtggcttgtcgcagatgatggcgatgcattacgggacgttaccgatcgtgcacgcggtcggtgggttgcgggacacggtcattccgtacaatcgctataccgatcagggaaccggctttagctttgacgactaccagccagcggttctacgtaaaattatggttctagccgtgaccttatatcggcagcatccactggtttggcggcagctgcagcaccaagcaatgacttgtgattttggctgggaacattctgcacagcagtaccgtgcgacttatcagaagctaatgcgttaggtttgatgggggtgtgaatttgaaattaacgtgtgcgcaatttaaaaaggactttctaagtgaaattgagaccttgtattcaacatcgctgagtgacacctcgacgattgggcaatttattgcactgggacagctagttcggcgctataacagtcagagttggacacgaacagctaaattttaccgcgatcatcatcagaaacaagtctattatttttccatcgagttcttgccgggacgcttactcgcttctaatttgttgaatctcaacttattgacgacggtaaaaaaagggctaacggaattaggcttagactttgagacaatcagtcaggctgaacctgatccggcgcttggtaacggaggattaggtcggttggcagcctgttatatggacgcgatggctagtttgaaaattgccggcaacggtaacggcatccgctatcgttacggcttgttcaaacaagttttcatggatggctatcaagtagaattacccgatgattggctccatcatggcaacgtgtgggagacccggcgcgataacaagagctgcattgtccagttcggcggcaatgtgtggttacaaccgcaagcggatggtagtttacaaccgcaatctgaaaatacggaagacgtgctagcggttccttacgacgttggtatcgtcgggtatcacaacgatattacgaacaccttgcgtttgtggtccgcggagttaccacccagtgcgacctattcttcgcaggataagcgtgatcgaatcagtgagattaccaaggtattgtatcctgacgattctaactcggccgggcaacaactgcgtttacgccaagaatactttttctcttctgcgggtgttcaaagtatcgtgcgtgatttttgtgcgacgcaccatggcatcaaattgttaggcaaaaaggtcgcgattcacattaacgatacgcacccgacgctggtgatccctgagatgatgcggctattaatggatgaacatcactgttcatgggaagttgcgtggacgttaacgacgcaagtcatgagttacacgaaccatacgattttacaagaggccctcgagacttggccaatcgatatgtttaaaaacctgctacctcggatttatcagattattgcggaaatcgaccggcgctaccgggaacaacaaacgccgatttttggcaaagcgctcgttgatcagacggcgcctttaggcaacggacaagtacggatggcctacctagctgtgattgggagtcacagtgtgaacggtgtcgcgccactgcatacggaattactgaaaacggatgtgttacggggcctgtatcaagtttatccggagcggtttaataataagacgaatggcattgcaacccggcggtgggttcaattggcgaaccaaccactagcgcaactgattgatcagacgattggttcggactggcggcggcaaccagatttattacagacgctactgccgtatcaacaagatgaccactttttgtatcagttaggtcaagttaaactgactaacaagcaagctttagccgcgtacgttcagcgtactatggggatcaagattcgcaccgacgcgatttacgatgttcaaatcaaacggttgcatgcttataagcggcaactcctacacgtctttgaaatcttgcgcgagtattttgccattaaggatcatccgcaacagccagtcgtgccgcgagtacacattttcggtgccaaggcggctcctagttatcactatgccaaggcgattatcaaacttattaatgtcgtcgctgacatggtgaatcaggacccggcgattggtgatcggttaaagatcgtctttattccgaactacggggtctccattgccgaactgatcattcccgccgccgacgttagcgagcagatttcaacggcctccaaagaagcgtcgggaactagtaacatgaaactgatggccaacggtgcattatcattggcaacgtatgacggcgcgaatattgacattatgcaagcggcgggtgctgaaaatgaatatccgtttgggcttaaggtcaatgaagtgtacgactattaccatcgcggcaactatcacgccgctgacttttacgatgctgatcctgaattaaaacggctcttagatagtttgattgatggcacgattccgggaattccaacggttggtcgggaaatctatgattcattactgcggtataatgatgaattctttgtcttagccgattaccgggcttatgtcacccaacaacagcagatcagtcgtgattttcaaaatcaacccacttggcaacaacgctcgttagccaacattgccgcttcgggacactttgccgcggacttagcagtggcgcggtatgctgacgatatttggcaagtgccccacgaacgactgaattaagaaaggaagggtgacggatgcaggtaacgtataactcatttttacccacgtataagacgccctttggtgctgtgacccgccagacacccgttcaattcacaatcagtgttcagacagtaacgccggttaagcagattgatttatgcgtggctcatgatggtcagtgggatgatgaacaggccttaccgttacatccaatcagtcccacaatgtatacggccacgtttataccgacccaggttggcctgtacttctactattttcggattgaaacggcgaccatgaccgcttattatggttgcgttgatggtggttatggtggcccgggcgttcaatacgtcttgcgcgagcatgttcaaatgtatcaattgacaatcttgaaagcagtagaaacattgccacaatggtatcgtgaaggggttgcttatcagatctttgttgaccgcttcaataatggcaacgcggatggccacgttaatgcgcccaagccaaatagctttatttatggtcaactaacggatcgcccactatacgtgcgtgatgaacaccgggcgattttacgctgggatttttacggtggtaatttgcgcggtattagtgctaagattccatatttacagcgactcggtgtgacaattatttatctgacgccgatctttgaggccagcagtaatcatcggtatgatacgggtgactatctgaagattgatccggtcgtcggcgatttgacggactttgataacctggtcgcggccgtacaccgggccggtatgcgactgatcttagacggtgtttttaaccatgttggtgtggattctaagtatttcaatcaggcgggccattacccgacggttggggcaactcagtcgaccacgagtccgtactacccgtggttcacattcattcattatccccacgattacgatagctggtggggcatccgtgatctgccgacagttgataaagacgatccaacataccgcgattttatctttggtaaacccgattcggtcattgactattggacgcaacgcggtgtggatggctggcgcctagatgtcgcggatgagttgccagacgatttcattgctggaattcgacggacccttgaccgttatccggataaggttttgatcggtgaagtttgggaggatgcctctcataaattagcgtatgggatgcgccggcactacttagagggcggcggcttacaggctgtcatgaattatccgctccgccgcttgattattcacgttttaaacggcacgctaacaccggccgaatggtggcgtgaactaatgaccctcaaggaaaattatcccgctacgacgtttcgctttaacttcaataacatcggtagccatgatacgcccagaatcctgactatgttagccgaagatcgccaacgcctacgtttggccgtccaactactcttgacgcttccaggtgtaccgtgcctgtattacggtgatgaggcgttgatgatgggggggaaagaccctgataaccgtgcgttttatccgtggcaggacgcagatcaggcgcaagttcagtttgtcgctgactgggcgaattggcgtcaacggcacccgtggttaaacacagcccactttgtgccgttttacttggcagattatggcattggctacctttattggcaggctgatcagaccgtgatggtgattgtcaatgtgactactgagccgcgaaccatgacgagtcacgatttaaagttgagtggtgtgcccataaaattagcacaagcgattcaacgctcccttgtgacgcagacgctgggtggtgaacagttgcgccttattgaaaactttacctaaattttacaggaacttgatgattgttagtacggttcagccgtatagtataattgtactttttaatagcaccccgctattgattatgtattacgaagtactcatcgatccttaatgagacgtaggcacattagtgcgtggctttccttgattggccacgcatttttgtgcgcttataagcagaatgtctgcgttgttcagacgaggtgcttataataaaggtaaacactaaagcaccttttcggatggttttaaatagacgtcatcacgaaggtaattagtgtatttgtggcgctggttattggccagtgactgattaattagggggtaattggttgtaccaagcagtagtgttttttgatttggatggaacgttaatgcaggacgataagacggttgcggccagcagtgtgcgggcaatccagcaattacgagctaaccacgtcctacccgtcattgccacgggtcgcaatgtattcgaagttcaagatgtgatgacaacggcggggatcgattcaatcgtcagtgcgaatgggagttacgtcgcgtatcaagggcagtttttgagtgcgcacgaactggataaggagcttttgaccgatattactcattttgccaatcgccaacagaatgcgctagcttattataataacgccggttttgcgttaagccatcgtgatgcattgacaaccagtaattatcgggcactcagacagacggcccgggtcgcaccgcacttttatgaacatcaacatattaatttcttactgacgtttgatccgttgaatgcggcgcaatatcggcagcgatatcgaggccgactacattttgttcgtaataatccgcgtgcgctggacactatgcaatggggcgtctccaaggcggttggaattcaggatatcttaaccaaggcgcatttaactaaggtaccgacctatgcgtttggtgatcaattaaatgatattgagatgttccgaatgatccagacaccgattgcaatgggcaatggtcatccgcaggtcaaacaactcgcgcggtacgtgaccgctgacaacatgcacggcgggattgcccaaggattgcaacattttgatttgatttgagaattgacagctagtctgataattataagcttccagtgagcagtccaactagtgagattagcgactggcttaaacaaaacaaaccggatttggtaaccatgacgtggtcgccaaatccggcttgttttgtgatgagtttaatggaaatacgttagtttagttgtgctttaatattggcgagtgtgagctgagtcgtatcggtaaaattgatatctgccgccactaaaacggtcgggtcaccaataccgatggcagtttcgccagcgcctttgatcgattgtacgccagccgccgcgtcctcgacaccaatacagtcagctggattaaggcctaaaatctcagcaccgcgccgaaaaatttcgggatcaggtttaccgtgcttgagactagcggggtcgacagccttcgtaaagtagtcgctaagaccgagcttacgtagcacaagcggagcattttttgatgctgaagcgagtgacaatgcgtagccagccgttgttaattcagtcaaaaaggcggtgatgcctggtagaatgttggctggggtcatttggttaacgagctgcaaataattggtgttcttttccgtagctagcgcttgtttttgggccggtgtgaagtcattttctcggtgcccttgagctagaatgaggttgagtgaatccatccgactgatgcctttgagcgcgtcagctaattgatcattccaactgaccccgactttatcggcgatctggtgccaagcttggctatgaaaagtagatgtgtccgtgataacgccatcgaggtcaaagacaaaccccttgattgctgcaaatttaaccatgttgaatgcctcctagattaatcggtataagtgacggaaagtggtttcttagcttgtaattggtaatgctgttttccaatcataatcgtgcggggttggtccgcagtgacggttacccgttgatgatcgataacgaaaacatagtgaacgccccgaaagagatgcttgaatttcaatgtttgccagtgttcaggtagccgtgggttcacctgtaagtgggcacctagtggattgaccccgccaaagttccgtgtcgtcaggtttaaggtcgcacacatgacgccgaggtgaatcccttcagcggtcgtcccaccttgaatgtcgtaatagtcggatgctagggcctctgagaaaagcttccaggcgtcatcgtcattatcgtcaagctgattcaaaacggcgtaaacgatccgcgagagagtggacccatgcgttgtgcgcgctaaatagtattgaatgttatgggtcagatactctttaggaagttgatatcccattttttcaataatcttctgaacagttgtgacatcgaagttataaaaggccatcaaggcgtctgcttgtttggccacttggtaagcatcgggtgtcttagactctgctttcaagatccggtccatccgggcgatgtcaccgtacttttgccgataagcttgaaagtcaagcgtcggtaggttgaagtacccctcaaattgagcaatgattccccgacgattgatttcaagtgttaattgatgactgatcgtcgttaacgcttgctcagccgttgagtcaaattgtgcggcctgagctgccgcttgaaaagcagcttggggcatctgcgcccgaagcgtggtgatcgtgtcaaagagccacgcaaccatgatattggtataggcgttattcttcaatccagcggtcgtgctgtttggatagttttcatggaattcatctggtcccatgaccccactaatgttataacggccattagcttggtcataatctgctttactgatccaaaaggctgcgatcgatagcaacatttccataccgtaatgagttaagaaatcacggtcctgagtaacgtggtagtaaaaccagacgttgtaggcaatatctaacgagacgtgtcgctggagccggctattatctggatcccaggttttagtaatgggatttaagtgagtgaattgagattgttcatcacccttggatgctgattgccaggggtacatggctcccgcgtagccttctgcttcggcatttttacgcgccattggtagtcgccggtaacgataagctaagagttgtttggctagttccggtcggtgcaacgtgtagaatggtaaaatgaacatttcgtcccaaaagacgtgtccccggtaagcttctccgtggagcccccgagcaccaacggaagcgtctaattggccgctttcaattgcggcagcggaaacgaaactgtggtaaatattgacgcgcagtaagcgttggcttgtaatatcgccacggatcttaatatctgtggctcgccaagtcgcttcccaatagtccttgctagtggttaccgtattgtcaaaactggactggtcgagctcggcttggacgtgggtcaactggggatcgctatggtcattactagttgcaatgacgacgttcttatcgaaggtatacgttttaccagcttctaccgccagtgaaacggtttgctgaacgccctgaggttgttgcgtgctattaaagttctcaattgcaggaacgtctgggctagttagtttggccccaatcgtgtaattgatatgtgatgatttggtctgaccagaaaagtagacggtattagcagccgtttcgatgcccatagtcttcagatgatgctgatcgaagacgttatagcggctaacgttgctattcacgacgctaccgtcgatttcggtatagatttgtagactacccgcaaagttgagtggggtgacttggtaacgaatgctgtaacggtgccaatcacgcatgttggcgactttctgcgaccggattctgagttgatgtccggaagcgagctgaatcaatttagtggtcgtcaagagtcccgttttcaaatcaaggctccgataagcatcttgtaaatcatgttcgttgagtgtaaagggagtctgatgatcaataccgaaagtcatgaactgagcgttcggtaaattgactaaatcttcattcttcacttggtggtcatgaacagtcgtggtggtttgatcatagaccccggcaacgtatgtcccaggataattgtccttgtcggcgtgactttccaaaaaggcgccccgtagaccaaaataaccgttaccaatggtcaacatggcttcttgaccattattacggacaccgtggtattggccgtagtaatccaaatgccattttaaataggcacttttagctttaactgcggctactagtccaagttgatcaacggcagcttggctaacgactgggatattaagcaaattagtcaaagctagcccgacatcaatgcgatcatagttgacaccgacgattgtgtctgagaatggataggacagtccgttttcaagaatagcagcatcgaattgaagtccggctaagcgaaccttgatgttctctagattttcaccaattgtttggtcagaattataggcaatcaggtaatgggccgttgcggcttgccccgatactggatgataagcgatatccatcgcgtcattttcaattcgcaatctaataagtttcataagtccacactccttagttcggtcattaaaaattgcaataagtaatcctaaatataaaaatattaaccataactacagcctagtctctttttacaagactcgcaaatattggtgatgaaagtaggggctgacgaggttgaaagtggcgttgttttcgaaggtgaatgaacaaagtgttctggcttgtgctgatgatacttggtctttgatgcacgtccggaatagtcggacgtgcttgcattaataactggtttgaaagtgatatcacgcttcgagccatgctagttgttgggtgaccaaagcacgaagcgccacaactagaatttgcgtagaatctagtcgtggcgcttcggttgtgtctttctgagaaggcctaatttgtaacggctaatctaagtgagcggggccgtcagtgggctgatcaacgagttcgagatggtcgatcgtcatcatctggcgaatcttgattgaacttgtctgaaacctgagaatgacggggtctttgtaatttagttgctgctgaaagtccgttagttcagcccgccaatcttgttcaaaaactttggtaccgactaatgagagttttccccgaagcataattgacgcatagtctgacagttggtaatagaataaactcgcttgacgccagttttgaatgttctgcgttgttgaagtttgacgactagtatagaagtaaagttcttctaggctccgtttgataggtaagggactgagcgctaccatggtcggaaagccgtccgcatcaacagttgctaacgtgaagacgggggcggtttggatcatatgtagggctgcctgacgagtcgtgtgttgcatacttagtcacccctttacacctcagtatgcaggaatcatgggggaaagtcatacgttatgcacaccgttttcagcgattaaaaactagggatgtgatatacttaagccacttaacgcgtggaacgttatgattgattggcgctcccaaggttaacgatgttgttactgcagtcagttctgagaggacttatctaataatgaagaatggtacagtaaaatggttcaatgcggataaagggtttggttttattacgggtgaagacggtaccgatgtctttgttcatttttcagcgattcaaactgatggctttaaaatcttagatgaaggtcaaaaagtaacttatgatgaagaacagggcgatcgtggcccccaagcaacgaacgttcaaccacaatagtaactgttgggccgaaccattatcattaactggttcggtttttatttgaagtgatgggttgtcagctaaacaagaaagctaagtggtcggaatggattttgtagatgtttacggcattaagcatgagaattgtacgttagttgcacctgcgcgtgaatatcagcgggtcgttatttttatggacgcattgggccggcgctttgttgcaatgggaccggatccacaaccaactaaatatggaagtagtagccaacattggcatcaagcacagccgagtgcagctcctgaaggttatttccatattgatcaagaataaccctagcaattgagttacttagctacgctgatggtaaacattagatcgttagaaaaagcctcagggacgtcacacgcactttgcgttgtgcttcctgaggcttttttgtaggaataaaaaaatcagctttcacggtggattatcacggcgtgaaaactgattagtgtggttatatgatgggcagtcaggggatcgaaccctggacccacggattaagagtccgttgctctgccagctgagctaactgcccataactcaacaaaaaatataatatcatgaattttgagttctgacaacactatttcgaaagttttttcaaaaaaagtgattttttgagtaattaattggtgaaaacgattgcttgaactggcaaatgatttcccgggaaatactacggccacgcggattagcaatcaaagaaagccaactacatttgtgatatactaaaaccagtgttgaatttagtttcaaccaaccctgacacgagaaaggacctgttttctcgtaatatatcgcgaatcaccctaaaaattgaaatgtaaacctgttttcccctaaggaggaagaatcgttatgaaaaaaatcttagtagttgatgatgaaaagcccatctctgatatcatgaaatttaatctgaccaaagaaggctatgaagttcacgttgcagttgacggagaggaagccttacaaaaagtggatgaagtccaccctgatttgattttgttagatttgatgttgcctaagatggatggcttggaagttgctcgacaagtacggaagaactatgatatgccaattatcatggtaacggcaaaggactctgaattagacaaggtgttgggcttggaactgggcgcggacgactatgtgaccaaaccgttctcaaaccgggaactcgtggctcgagtcaaagcaaatctgcggcggcaaggtgcaccaagtgcccaaccagctgaagttgaagaaaattcagacattgaaattggcgatctggtgatccatccagaagcttatatggtttccaaacgcggtgaaaacatcgaattaacgcaccgtgaatttgaactgttacattacttagcccaacatatcggccaagtcatgacgcgggaacacttgttgcaaacggtctggggctatgattactttggtgatgtccggacagttgatgtgaccgtgcggcggttacgtgaaaaagttgaagataacccgagtcatccaaaatggctggtgacgcggcggggcgtgggttactatctccgcaatcctgaaaatgagtagaggttgctaaaccgtgttgagatttaaacggaaaaatttttttaaaacaattaatttcaaaattgcgctcgtgtttgcccttctattattgattacgttggaaatcgtgggtgcaatctttgtgaaacagttggaatcaaagaacatccaggattttaaacagtcggtgcaaattccaacttatattgataattcgttgtccgaacaattgaccgtcagcagtacgcgcaaggccaacggccaaatcaagacgattttgtcgaactacaacaatacgaatgttgatgaaatccaagttgttgacagcaaaggaacaattcgtgggacgagtgatgttaatgatcagtcagtagttggacaaaaaacgaccgatcgaaacgtcaagaatgcgatctataataatcgaacttacactaaaagtacctatgacactcagaataatggacgctactacgtttcaatcgtgccgctatatagctccaattcagcgggtaatagcagtcagttagttggggtactgtatgtacgggcaaatatgaagtctgtctacagtacgattaacaacattatgggaatctttgtgattgcgtcacttgctgcgatggtcttgggactgggaattgcaatcattattgcccgggcaataactcgtccaatcgaagaaatgaagcagcagacgcaacgaattgcccgtggtgattatgcggggcaagtccgagtttatagcgatgatgagttgggccagttggctaaagccattaataacttgtcgattcgagtggaagaatcgcaagagtcgacagaagctgagcgacgccggttggatagtgtgctctcacacatgagtgatggcgtgattgccacggatcgccggggtaatattaccatcatcaatgaaacagcctcggactttatggacgttacggccgaaaaggcaatcggtaactcgattttagatattttaaaaatccgtgatgattattcattgcgtgatttgattgaaaatcaagatgaattgatgcttgatttttcttcgaacgagcgtgacctaatcttgaatgcctacttctcgttaattcaacgggagtctgggtttattagtgggttagtctgtgtgctccacgatgtcacggaacaacaaaagattgataatgaccggaaacaatttgtttcgaacgtgtctcatgaattacggacaccactgactagtttgcggagttatattgaagcactgagtgatggtgcgtggaaggatcctgaagtggccccaggatttttgaaggtcactcaagaagaaaccgatcgtatgattcgaatgatcaatgaactcttaagtctatcacggatggactcagggaccacccgggtcgatatggaattggtcaatattaatgagatgttcaattacgtgcttgatcggtttgatatgatcttaaagaaggatgataatccagctaagtattacactattaagcgcgagtttaccaagcgtgatctgtgggttgaaattgataccgataaattcactcaagtattggataacattatgaataatgcgatcaagtattcacctgatggcggtgtcgtgacttgtcggctgttagagacgcataaccaagtgatcattagtattagtgatcagggcttgggtatcccacgggccgacttaggacacgtctttgaccgattcttccgagtcgacaaggcgcggtcacgggcccaaggtgggacgggcctcggtttggcgatttcaaaagaagttgttcagatgctcggcggtcgtatttgggttgatagtgttgaaggtaaggggtctacgttctatatctccttgccatacgaaccttatgaggaggaggacctttgggatgacgactcacaagcttagacgctttatcttacccattttattgacgattctgatcttattgagcgtggttttatccatgtatatctggttgaatccgtcacgctatgagcatgaaagcaaggttagtacgacgtcatcgaactcttcgttgacaactcggacaatcgatgatatttatttaccgacacaattaattcacactaacagtcagggtggccaatccctgctgattaataaaaatgtcagcttagtcagtcaatttagtgagcagttacgcaaatgggatgcgcggagtatctctaaagttcgcattacgtcggcaaaaagctaccgtgcgctcttaaatggaactgattcgtacgtattgaactttcctgacagtattactgtcagtatgtttaatacggtcttcaagcaacatctcagtaattttcgctcctcggaatttagtcggatcgtgattccaatcaatgatacgaatcacatctactttttgaatgatgaccatcatgagatttatagtgttcggttgaagaaaaaatctctgtcgtcgttgaaaaaagttttggcagtcgacaaggtcaaacggattgctgtcaagatgacctatgaggataatacaacgtatattgattatccaaagcaagttacgatgcaacattatagctacttgatgagtaaagcggctgcgagtgagattgccaaccgattactagatgcggatggtaattcgaccgtttcagtgcataatcgcagtggtaagcaggagtatacaacgggtagttacaagtgcatgacggtggattctaagctaggaacagtgtatttcgaagattatagtgattcaggaaccacgcggaacctatcactgactaatcagctaaagaagagcttcaatttgttaactagtctcggtgtcccaatggataatatccgctactacggttttgacgcaacgagtaatagtgtcatttaccggagctatgttgaagggttcccgatctttaatcagaccgaaaatggcgatgtccggattcagctcacttctaacgggttagaccgttactacttctcactgtacagtttgcaggtgccagtaccaactactggtcagaagcaagcggtgaccttaccgagttcgacaagtgtgttaaaacgtctgaaggccgctggttataaagacagtaaaattggcagtattgaacttggctacgaatggtcacagaacaagtcgtccaaactcgtgatcgacctgacgccgacgtattatgtctactataatggcacttggcggacatatacgtcgatgttaagtggatcttaggaggtggccgcatgaattttcggagaattgagtggattttcctactagcatttgttgttctagatatcttcttgggttttatgttcgtgcaaacgagctctaagtcgacacaaacgactggtgatacggcgaccacgataattcgtgaaatgcgcgcagataatattagctttaaaaacccggacacgagcgaagggacgggttactatattgcgggcagtaacgagagtggtctcaaacaattgttgagtcagttaactgaacagacagcccgggtgcaaagtggcggtaagctcgtgagcacactacgggcaaccaccactatcgatacccgcaatcctaaagcggacttgacgacgtttatgagtcagcggaccaatgtaatccatggaaccgagtacgtctatgatgcggatttgtcgtctaacggcgattacgtttttgttcaaaaggttgcggatggcgagatcatgactggcgctgggcaagtccacctatttgttaataaaaacaagcagctgacaagttatactcagacgtacgtcaatcacgtcaaaactttacgcgaaaaggctgttacgatcagtgaaaaaaaggccctggttgcgttgtatcaatataatcaggtggcaagtagttcccggatcgtttgggcaaagcttgggtattctcggttattgaaattgaaggatagtagtgtttacgtcccaacgtggatctttgcggtccggggtaagaatagttctaacgttacactgcaccgtatcaatgcctttactggttcttcaatgaagaacggtagtacggctagtgatacgagtagtttagatgcgacggtcggaatgatgtggaatgcaattgattagtgaaaaccaatttaacgactaggtgtcgttgtcgaataacgggtgctgtgaagaagggtgtttttcttaacaggcccgttttttggtgactagatttttgactagttgtgatacgccaatgttgaggtgccatggacgtagcgtggattgctcagcgttgatgttcgcggtttcgtgtgagtttataatggtcggtaaactagtgcgcgcatacacgacagtaaactagactaaccgcgtgatggcgatagtcgtggacgttaagtttgagcacttgcaggtggcttgcttttcaaccccgctaaaagcgtgtatcatatgaagatagtaatggatttcagagataggaagagcctaaataatggtattaaaattagcaacggatgatatgaaagtaagcattctggcatcgggtagtacgggtaacgtgacgtacatcgaaacgccagagcacaaagtattggttgatgcggggctaagtggcaaaaaaattgctaatttaatggcatcgatcgatcgtgatattaatgaagtcgatagtttatttattagtcatgaacacactgatcactgccattctgcggggattttagcgcggaagtatggcatggatgtttatgctaatcaggggacctgggacgcaatggcgcataaaatcggcaacgttcctgccgaattatgtcatgtctttgacccgaacacgacgcttggactaggtgatctcgacgtggaatcatttagcgtgtcacatgatgcggccgagccacaattttatgaactacatcatgccggaaaatcgtttgtcatcattacggatacgggctacgtttcagagcacgttgaaggtgtaatcaaagacgctgacggctatttatttgaatgtaatcatgacttagaaatgttgcggatgggtcggtatccatggccattaaagcagcgaattattggtgatgagggccatttatcgaatgaagatggtgcgaacgccttgatggatgtgattggccggcataccaagcggatttacttagggcatcgtagtcaggataataacttgaagtccttggcgcatttaacggttgcttccatgatgacggaacgagattttggcgttgagcatgattttcaattgtacgatacggagccagaacaagcgactaagttaatcacgttataggttagctttaatgtttcacaacgcttcagtcataaaaaaatcacactttttcgctaaaataaacttaaaataagcattagtagggagggatcgcgtttcgacgcgcaattatggctaataaatcattaatcaaagtcgcagtaaccgcactagtagctggtttaatcggtggtggtgttgcttacggcggtattaattatttccaaaacaataacatcgcaacgtcatcgaccagtgtaccaactggttctaataaatcggggtcaacgtcaacgacgaacgttaaggtcaatgtcagttcacaggcgaccaaggtgtttgaaaataacaaggcggccgttgtatcggtcattaatctccaaaagaagagctcttcaagcagttggagtggtattttgggtggcgatgactcgtctggcagtgatagttcatccagttcagattctagctctagtaagctggaagagtacagtgaaggttctgggttgatctataagaagagtggtgacgcggcttatattgtaacgaataatcacgtggtgagtggttcaagtgccattcgagtgattatgagtgatgggactaagttgtcagctaaaattgtcggaaccgattctgtgactgacttggccgttctgaaaatcaattcttctaaagtaacgaagacggctagctttggtaactcagataatatcaaggttggtgaaacggccttagccattgggtcaccgatgggctctaattacgcaacgaccttgacgcaaggaatcatttcagcgaagaagcggaccgtggcgacgacgaatacatctggtcaaacgacggggtacgcgacggttatccaaacagatacggcaattaactctggaaactctggtggtccgttgttcaacattgctggacaagttatcgggatcaactcgatgaagttggcctcagataattctgggactagtgtcgaagggatgggctttgcaattccaagtaatgaagttgtgaagatcatcaatgaattggttcaaaagggtgaagtcgttcggccggctttaggggttgcaacctatgacctatccaatatttcttctagtgatcagaagtctgttcttaagttaccaaccagtgtgacgaagggtgtcgtcatcatgaagacgtactcaggttcaccggctaaagctgctgggttaacgaagtacgatgtgattacggagctaggtggcaagaaagtgaccagcttagccacgttacggagtgccctgtatgcccattcggttaatgataccgtgacggtgaaatactaccataacggaaaactcaagacagccaacatgaagttgacggaaactaccaaaacgttaactaaacaaagtaactaataaatgagaatttcataaacgtccctgactggataaagcagtcgggggcgtttttttaggttagtagctgaaatcatgaaaaaacgaagaatcgattttcaataatcgactaaatttgcgaaagctggcaatggttgcgacaaaagccgaacaaactggttgaaatagcagaaagcatttattgtcgaatttgatggtgtgcaaaagtgtggacaactttggtgataaattttagccgcgttagtcaaaatttatgaacagccggaaccacggggttgaagcttgtttaaaagttatccacagacgccggactggcctgtggatttaattttaaaaagttattttaataggcctcggttcttgatataataggatttgtaaccggaatccacgaacaagtgttgctgtgcaaaactgtggataagtcggaaaggtcttgacaaaacgaggctaaataaatattgtggcgaactggtgttcaacacaatatattgattattgagttatgcacctgtggataactatgttaataacttgtgtaaaggcggtcaattatgaacatcaaaattatctgtgtcgggaaattaaaagagaaatacttcaaacaggggattgcggaatatgcgaaaagaatgagtaaatttgcaaaattccagattgttgaagtgccagatgaaaaggctccagagtcattaagtaacgcagagatggaaaatgtgaaggccaaagagggccaacggatcctagaaaagatcaaggatcgcgattacgtatacgcgctagcaattttgggcaaagaacgctcgagtgaagaatttgcggcggaaattgataaactaacgacgtatggtcacagtgatattgatttcgtaatcggtggttcgctggggttatcaccggaagtgctgaagcgcgcggatactcagatttcgtttgggcgtttcacgttacctcaccaattaatgcggttagtgctgtcggagcaggtttatcgggcgtttatgattaatgtgggaagtccgtatcataagtgaagagaaaacatataacttagaattttaatgcagatgtgtttattttatattgaaagaaggtaaagctggtacttcttgattttaaagtgtgagatagatacgttgtattaggttaatgaatcgcatataatcaaggatgaaattaaaagttgtcccaatagcagcaaataatggaactatgggacggaggcggaatatgaaaaatatggcatcattgttaccatcattagctaaatatatttttttaaatgaaatagacaatgcagagtcaacgttaattgctatgctaagattgttaaataaatctgaaaaaaaagaagatcaaagaatatctgcgcaactatcaaaaattatcaaggagtatagagcaggtttcttttcagataatgacgtattgagatcggttaataatagtcaagatacaattaaacatgatgactttttccaaatagtacatcccaatgctagttttaattcattaatattaaatgatgatattaagacgagagttgaaaatatattggaatcttatcgtaatgagaaaaaactttttgataatggtgtattgccaatccggcgtgtattaatcagcggtaagcctgggacaggaaaatcaagtattgcagctgtaattgcgagggaactaaatcttgagcttttaataattcgtacccccataattttttcgagtttgatgggagattcaagtaaaaatttaattacgttgtttgaaaagattcaagatcgctcggctgtaatattgtttgatgaatttgatagtattgctgtaagtcggaatagtccaaacgaagttggcgaaatgcgcagagtggtaaacacaatattgactatattagatcattggcatggtaaaggaattttaattgcaactacaaatgaatcccggcatttagatgaggctgtttggagaagatttgatgaaacgttagaaatgaatttaccagatgtatcgcagcgtattgacttgtggaataagtactcagaccagatattaaaacgagatgaattacgtattattgcaaatatttctgatgaaaaatcacctgcagatattgagaatattatgcaacaggcaaagcgaaacttaattctcaaaaatataccattgtttgaaactattgtaagtattttagggaaaaatgcgaaaacaattcaacaaaaaaaagagatttcaaaaaggttaaaagatattgatcaaaatttaagcatgagagagattggaagcatgttaagcgtgtccaaaagtacgatacaacgatatttacaagaatgagagggatgtataaagtatggtagaaaaaaagcatttaattattagaaatggagctactctacatagattagcggaaaaaccaaataattctttctcaccagaaaagccattgcgaaatatggaagattcaatggattttttagcaagtgaaataagtaaagtattgaggataatagagttagataatgaaaatgattttttgtctgaactctttttaacttttcaaatgccccatagatttttagctaaatcatatgaagtagagtctatatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacattgaccaacgatccaaatataatcaatctttggggcgatcaattgaacagcgtcccatgatgattaatcaacgtaagcgcatcggcgattttaaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtaggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccatatataaaaaagccggactagttaaggtgggaacgagtgatttcaaagatcgtaatcataaagtgggtaggattgatatagtaaaaggatcgaaggaaaatattgaaaaaattattcaaattattcaaaatcccataacaaaaacaataaagaaggaaatgggtaggatagatggaattggtgtccctaaaccaatcatttcattaaaggaagaagaaagattagatgaagtaagctattttgaactgtcattttataatgttgaagatactgatgctttagcaaaaaggctatcaaaattattgaattgtcaccttaaatcaactgattttagaagaatatatggagttttgtatttaggtataaatatatcaataggcaatgtaaaaaaattaactggctttaatgcattaagagcagcaaatgcctttaataatagaaattcattcgacacaagtcaagaaattaaaatcaataaacgtatgtatactaagcctataaaatctttacctactgttgggatgattgatggtggagtggttctagagcataatgaattttttcatgatgtagttacagaaaaatatcaagtttcatgtgctgcttcgcaggaggcacaggaacatggaacctcagttgcaagcattattctatatggaaatattgatacgtcaattgacatgccaattactccggaactaagaatagagagtgttagaggtttgccatcagaggaaaatgaagtgtttgatttggtatcacttgagaatatcatatcagatagtattccgaatttgagaagtataaaaatttggaatctttcagttgggcctcgcgggatgcttttagacggtgatatttcttcaattactgcattattggatattttggcatacaagtatgatgtcctttttgttattgctgctggaaatactggaaatgaaaatggaatcatgagtcggcttcaaatacctgcggattctgtaaataacattgcagtaagtgcatacggttatctcgagggtaaaaagatttcggcatcttatgactctattggcccgggtagagaaggtaataagatgaagccggatctagttgattatggtggctatggtggaagtgactatttagaagcagtgggtagttatggttataatagtaacgaatgtgtagggacttcattctctgcaccattagtaactcgaaaactaggtctgctaatgtggaaatacccatctttaagtgtattagatgttagagcattggtagcacattacgccgccttaaacttttcagtaaaagaaagaaatattttctatgatgggaagggggaattaaatgacgattataatgatcttgttactgcgagctcaaatgaagttcgtattatgtatattggtaagctaaagccaactgaatatcaaatacttgatatgccgataccctcgataattaatggtaaaacattggagattacttggactattgcagtgaagacacctgtacatccagaaaatccggatgcgtatactgaatttgcaattgaagatgccttttatcctgattcagataaatataaattttataaaaatgacgatttccatgaagaaaaaacacagaacattaaagatagcgaaaaggtacaaacgttaactgaacatggatttaaacgttctagttatcctcagaaaaataataataactattatgtatcagatgttcctgatggactttatgatgatgaagaagcacttcgtaagaaaaagttaaaatgggatactgtgaaatcgcaatctgtaaataaacgcgagaccagtttaaataaaccctttattagattgcacgcgttatcaagaaatggtaaaaatgattttgttaactatacaatggtattatcaattagagtaaagaatgatgtggatttatatgataatgttttaaatgattaccaacaattattaccaattagtgtgcgtacgactacgcaaacaaggatataagtactttgttaattagttttgatggtgattgttttgaagaacttaatttatctacggatagagttcttttttaattctatatttgatttgaattcggcagataaagttttattagtgtccatattattaattaaaaaacgactattctcaaaacagctgagtattgcacattaagtttgtgtaacttaataatttaattatccttagtcgtcgatattaagtggaaaaatgaatgatgattggcatattggtgcttgcgcttacttataacatggttcgccatattataagtgaaatatatgcatgttataaaattaatgataagattattctaaatataaaagtttatatttgccggaatgggatgtgattgttagtgaataagttggaattattaaaatcgttaaacgtcggttcttatgttgccgaaaatgagcctaatttgagtgattactttgttgagacaaatctttggaaaaagcttattactgataaagttgatattgtcagaggccccaaaggatcaggcaagagtgctctattaacagagctacgtagcagtaattcattggatgaaaatgttcaaatagttgatgctgaggagataaagaatgagtcggtgtttcaaaaaatattttcaagtagagcggcggcgaatataagtgcacatgagctccaattcttgtggagaatatatttttgccagttgattggtagggtgattttgggaaaaaataatgattatagaatgttgggtgaaagcactaaaaagtttatagattgcttattcaaggaaggattattatcggaaaatttagtcacacatacggggcttttacgaatatttaaaactggatttgattacgttatgaaacattcgaaaagatcagtaaaagttaatacaggtacagtatctggtaaaattgtatttgatgttccatctgaatatcaacaacaacaaggatatatgtatgttggagatttactgcaattagctgatgatgcattaagagagataaaattaaccgtatggatttgtttggacagactggattcggcttttgaagatgtacccaaattggaaaatacagttctaaaaagcttaattaaacagtatttagatatgcgtgattttaaaaatatccgattaaaaatttttattcgtagtgatatttggcagcggataactgtagatggatttgtggaggcaacccatattgctcgcttagaagaagttaaatgggatacgagcagtatcctttatctaattgtatcgcgtatttcaacttctaaaataattgttgaagattttggaaagtctatactgattcctaaagtcaaaagaaataacatcttgaatagtgaagatttgcagaaaaagttattttattatgtttttcctttgaaagtagatgctcagcccccatttaataaaaatgtgaaaaaagcagatgctattaattggattatttctagaacgtctgatgcaactagaataattaatccacggaatattctttatttaattgaccaagcaaagtcaattgaaatagacaaaatggagagaggacatcacatgccagtagatggactgatggaaggaaaaagtaattcaagaagggttaagggaaacctcgcattatcaattagagcaaacattgtttgctgaatatcccaaattgaaaccaaaagtagaattattaaaaaattctaaggctgaaatgaaattaaatgttattaagaaaaagttaagggtcaacagtaagaaaggtattttagagatagttaatgcgcttattacgagaggctttataagtcaagctaatagtagtggatattatgaaatccctttcatatacagagacgcgctaaatgtaaaacagggaaaggatcctttggaaagaaaagtagttatgtcgaagaatcgaaaaaaagaaaataaaagaactgatgatccaaatcagctttcccttttttaaattatatagtggatctggaatttgcaggtcactggcttaaatcaattagtttaaggttagatttttaataattgaacttaatgtacattctgagacaaaagacaactaatgatatagttcttatttacatctatttttgtattgttgtctaaataagcatatatttttcttctgaatttgtcatatgtgttttatagatgtgaatactctaatcaatttatttatgattgtggaatactattaccataaaaggttcattttgctggtgaaaatcaagtatcgtaatataaaagctatttattattcctgaattgtcaaattaattgcaaaactttcagcctattcttaacgatgatttcgtaatggctcaagagctccgataaggtcatgatggctagttcactggcagttcgcttacctttgactagaaattttctcaatggcctaattcggtgtgatcattgggaccagctggttggtcttcaatggagcgcaccagcgttcgtttgttcatacattagtgcgttttatgagctgactttacaaggtggtttcggccagttcattttgaaccagtggacaaaagtgtcaatgctataaacacgtggtttacgtcggagtgccaccatgagttgttggagaaattctgagaatgtcaatagctcattgacggcatgacaggtcgcgtgatgactgttacgaacaccttacgtgatatctgaaaaataaggttttatgattagcctagatttggagaactgtgctgtatttcagttcttgactgattgtgtttaggatttgatgaagttcgcaggcaacctgacggcaagaccagccgttggattgatgcgctatgatcaggccaagttcacaggattcaagttgttgatagtgacgagtaaagatgttctggttgtgggctatgaagatatttctctcttattgattggtaactatagggataggccttaatgagctttatagtctagtcttttaggtgttgcacttcaactttaaatctgtaggaaaagtatcgtcactaaaactaaaaacgaatcgcaggtgcatccatatcacaacaatcaaagaaattacggaagctatcaaggctgatcccgacaacgctgaatatacggcgaaggggtgggacccgctatttcatgttttaccgacagccactattttagtgattagtcaggcgccaggacgtattgcccaaaataccaagacatatttcaatgatgcgagcggcgaccgacttcgggattggatgggcgtgacgcgggagcaattctatcaaggtgaccgcattgcagttatgccactagatttctactatcctggtaagggcaaaagcggtgacttgccaccgcgcaagggctttatggataaatggcatgaaccgctgctagcaatgatgcctaacgttcaactgacgttacttgtgggccaatatgcaattaaggcttatttaggacattcacggcaaaaaacattgactgcaacggttcaaaactatcaggattacttgcccgattatttcccgttagtgcatccatcgcccctaaattatggctggcaaaagaagaatccatggttccaaacgaccgtggtaccagatctccaacggcgggtaaaggctgaattaaaataatgtctacgatatccctgttaaacctggtgatcatggcttgttggctatgactgttaagtgcctgatttggtaaagacgtggtcacactgcgcatggcttgctcggtaggaccacgtttttagtttattgttttatgagagcttagctaggtaagtttttggctttaaaaagatagaactatcttttgtgatgatgcttattaatcatcactatttaaaatataggagctaaaaattcatggaaacaattaaagcgattcacacccggcattcagtccgggcttttaaagacgaccctattgagccacagctattaacaatgattgttacggatgctcagcaaaccccctcatggggcaattcacaaccatggcaagtctatattgcaacggggcacgcactaactaatattaagcaacactatgctactgccgctgagcaagggatgacgaaagacgctgatctcgccaaagtacaccggggtgatttttcggcgtttgctagccaaaatatggggcactgggtcggaacttttcggcccgtgatcgactcagacccgaccacttattgggatagtcgtgctaatctttatcgcgcccggcgattgcctatcttgtgctcgacgctaaccctaatagttggtcaatctatgatttaggcgctttttcgcagacgttaatgttggccgcaactgctcgcggagtacagtcagtaccatcttatgaattggttaaatatccggctattgtacgaaatgcactcgggatgcctgcgaataaaatagtggcgatggggattgctttaggctatgagaagcctgaaaaaccgttaaatcaatttcgaactgaccgagttgctacgccgcaagttttgcatattatcaactaatttagactcacttttgcagcagaaaaccagctgtttaccagcagacactattgccaaccgacaccgtttcatctaagatggagggtaacttgaacctgataggggaggctgggcaatgccgactaaacaacgaacgtacaaaattaagtcctatgtcaacgctagccatgcggtgcggtgggcaactggctccggaaaaaagcacacgcatacgtgggaaattgtttgtgaattgcacacggttgatgcgatggtcgctttttacgatattgaaaaaaacttgcatcaagcgttggatgaattgtcaggtaaatttttgaacgacttacctgaatttaaaactgttaatccaactgttgaaaatgtcacggagtatttatttaccaagattgataagacattgcgagacaacggggcgcaactgctgcgaattgaagttagtgattcgccaacacgcgcttattgtattagtgtcaccgaataagattaatgaaagggaccaccaagaacggcagttgcagctgttcttggtggccctgatttttatttaattatcgttttggacggacaactgctaaaaagtcagctaaagcctgcgggttggtcaattgtcgattacactgattgctgtcacgacaaatgtaattgccgttacgcgtgtaaggtccgagaccagatgacttggttgtcgacataaagagtgcgacgttgccaattgtttggcaaatggcacagacgcccttgactgtttgtggtgctaaatctccctggataccaatgagacgatcatgatccgggattactaaatactttttctggttaccaccatcattccaacctaggtaagtcaattcgtgtaatgctaattgtgaccatacaggctgcttcaactttttgaccttgcgaaacaacttgcttagttgctttgtcgtcaaggatggaaacggaataattagcggaattagcgtttcaagtagttgaggggccttggcacgggttagccggtccgtttgcaaatgggacaagaaattagcggtgattggattgtcactaggaagcagtggcgtaatccgctcgatagcttgtgcccgtacgacggctctaatttgaagatcgtttacggcgagctcggcgctaattaactgattgacttgctgagtaatataactgtattgataggtggtaattgtcggttgcataatataattcctttcagattcaaaccagacacttctctgaaaggttctgtcgaaaagtgtcgctaacgagcagcacttttgcgtacagataatgatgccatcatcattaatcatctccttattgtggccgattatagccacagcgataaacagtataacggatactgctgattttggcaatagatggtgtctgttttgataggcaccttgcataacttatatttggaaatcaaataccgtaagtcctaaaatgtttcacgtgaaactttcgccacgggacactaaaacatcacgcaactcgtgagttacgtgatgttctcaaatacatattcgctttgaattgtgcttaattcgtgactgaatctttgacttgtttcagcgcattttggaccgcttctttaatagctcggctagatgcagaggcacctgaaacggcgtcaacgctagtggagttggctgccacaatttcttgtggaatttgatcgatagcggttaaaccaacatcttcactttcatggtgttgaataacatcgactgcttgaattttatggtcgttgtaagtcacacgcacaataactttgccacctagcccggcattggaactgccgagatattgatcagcggccagtttaacattagatgctgtttcgccatcaacaaggtcattaattccgttggcttcgttggcggtgacagattcactatctacctttggacgagcagcgttttcaccggctaacttaccaaagatcaaacattcggctaaattaccaccaccttgatagcagtttgcaacgataccgcctaattcaccagcgccgaacaagtgtggaataggttcgtcattgacgttgagaatttgggcattttcattgcgttgtggccccccttgcgtgttgaggacgtcattggccgcagcaatggcatagtaagggccatcgtccagttgacgcatcgtttgcggatcacgaccaaattcaaaatcacgtcccacttctgtgtagtgattaaagtcagttaccgtctgttgtagattattagcaggaactcccaatttggcggccaattgtgcaatcgttggcgcggaaacgagtttggtcatgaatttcggatacggtaactgaccagcctgactttcttcttgtttgaaggcatcgtactgggtttgatcaaaaattaagtaggggtgctgattattcattgggattagccaagagccatgtgtgtaaacgtgtccgtgacggtgcttagcgtcttcttggaagtagcgtgtcccgtcatcagcgatagcgaaaatactaccgttctttaataaaggccagtgttcaatttgacggccccgttcattggcgtcttctttgaaggtgattccaggtaagataccgtgagattcataattagtcatgtgccacattttggcatcaacttcttgagccattttgataccatcaccgcggttatagagcgtcccaagtggtgtcagatgatcactgtgcaagtaggtttgctttaactcaggattgttttcaaaaccacccatagctaaaacgacgccattattggcatggatattaagcagtcgctcgccccgtttgatttggaccccttggatcactttagtattaggatcttggatcaaatgttgtgcccgtgagtccaaccaaacgtcaatattgtcagctcgttcaaggactttttgccggagtagtttccataatgcagcgtctttatcacgtttgtgaacgagggcaaagtcaatcgtatcacttccggctagttctgggtattccgccatggttttcttgatggcaacggcatcaccgggtttaatatcatgtttccaactaacggctttaatccccagatatttttcaaaatatgctggaattttactcatgccgcttaaataggcgttgagtgtcttagtaggggtactgaatggcgcgcccagtgcttgataataagcggttagtttatctaagctttcacccgtaacgacgtgttgggcggagtagcgggtgttgccaccttcacggccaaatggtgccgcatcaactactagtacgtgggcaccattatcagcagcaaaacgagccgctgaagcaccggcaccaccaaagcctaaaacgatgacgtcgtagttaccgtgccagttcacattgagcgcgggcgtgccgttgagtgccttaacgtatttttcaaagttatcgaagcaccgttccaagaacttgatagaaggggcatcggtcatttgaccattctgatcaaaggctttagcagcgtagcttaacatgtattcattgccagggagtacctgagcatcaactccgggcgcattgagaatattgcgtaagtcaccttgagcacggcacgtcccctgtacgccaagggaagtaccaactaacatgaccggtttattagcaaaggggtggagctggtaagaaagccattcaataacgttcttgagtgcggccggaatggcatgatcgtattcgggtaccccgatgatcaccccatcggcctggctaattttatcatttaaggcttgaacggtcgccgggatatgattttgagttggttcattaaaaaggggaatccctgtaatttcattaacgtcaatggtagcccgttgactaaaataatgcttcataaattgtaataattcacggttgtaagactgttgtgccgccgtaccaatcaaggcaatatatttcataattaacattcctttattagtttttagttggataagtatacgaattgtttacgctttcaatataaatagttacctagaaaaaacaaccgttaattttaacgaagccaacagaatgctattgtgacaaggataacaagctgtgattaatttgacgggttgtcgaaactttagtgagaattaagcaagtggcaaactttattttagctttttataaattctatttataaaagtgtccgataaaaggcactagtcgctatgataatttcaggtatttttaatcgcaaacaggtccctgtaggctgtatataacgggttttattgcgacacctcaagccactacaactaaatttaaattgacagacttataaattaagttatggtgatattgaaaaacggcaaacaaccgttaatggcaagatatgtgaaaatattaacaattatatgaagattaggaggaagtgcagatgttgagtgaaataaaatggaagggctttctgttaccgctaatttttggaattgggttatggctagttacgccactacgaccagtagcaattagtattatggcgtggcacttatttgcaatttttgtggcaacgattattgcttgtattaccaagccattaccgatgatggccgtcacgctgattgggattgttgtcgcgacgttaacgggtgtttttacgatggacgaagtcgctactggttttggtaattcgacggcgtggatggttgccatgtgcatgttcatggctgctggttttattaaatcaggacttggcaagcggatcgcctatctgtttgtcagtttatttggcaagcgcacgctgagcttagcatacgccttatcctttgttgatgccgtattggcgattggtattcctagcaataatgcgcgggtcaacgggattatgtatcccattattgataacctttctcgtgaaatgggatctgatccgaaacagggcacacagcgaaaattaggctcatttctagtttttaatgaatatgaagttaataatattacatcaggcttgtttttgaccggtttagctggcaacatggtggctattggtttagctaagatgcagggaatcacagtaacttggatgcaatggtttatggctgcttgtgtcccaggtattttatcgctactaattattccatgggtactatataaagtctatccccctgaggtgaaacaaacgccagacgcgcaccgctgggcaacgacgcgtttggccgcacttggaaaaatgacagctagtgaaaaaattatgtcaattacctttattttagcgattgttttatggttgatcgggactaaaattggcatcgatgcgaccgaagtaagttttatcgcagttattattttgctgattacgggcgtgttaacgactaacgatttgctcaatgaacattttgcttggaatattttagtttggttatcgatcatcatgatgatgtctaagaagttaatgacactaggctttttcccatggttttccaaaacgttaggtcatttactgaatggtatgaactggattagcgtgctcattatcctgtttttagcttatttttacttacattacatgtttccgagtgtttcaacacagatttcggcgttatatgctggctttttatccatcgccattggtgccggtgttccccatgttttagcggcgttactattggcatttgctggttcaatcaacttgtcaacgacgccgtactcggccgggcccgcggcattattgtcaagtacaggctatgtgactagtgcggagtggtggcgattgagtgcaattattggggttatttttaacgtcatctggttaggtgggggcttgctgtggaccaagttattaggcttttggtaagactaactgagcaatatagatgcggtaagtcatgattgatcctgaccacgatttgccacatttttcgtgttaaaattaggtattaaatagattgaatgggggcgttgacgtgaatgaacgcgatttaaagtacttctgttcattagttgagacgggaaattacacggccacggcgaccaagtttcacgtcacacaaccggctatttctgcagctttacgacgattggaagaagaataccaagcagtattactaacgcaggccaaccatcgggcccaactagtaacgacggcagcggggcggaccttgtatattaagtctaagcaactcttaaaagacgttgcgcagatggcactggaagttcatcacgctaatgagcagcaagttcggctcggattttccaatgttgcgggtggtatttggcttccccgggtgataaaaaaatttatctcagttgatttattagaccaggtcacaacgaccgttgctgattcagaacaattgttagttgacttgcggcaaggcaagttagacgcagcggttttttcaactttggtcccagaacgtgccacggatttacgggtgagcatcttagaggaacatcagatgcaggtcttggccaatgtcaatagtccattaagtcacttaaaaacgattcgagcaactgacttacaaggagtgcctatcatcgctcgtcctaaacacgcattaccacggttagcattagaacaatattgtcagcgcggccacatacagcctaaaatcgtctacgaggcagctaccaacgcgttagtcgaaggtctagttgctcaaaacgttggtgttggggtggtcattgcggattccgtagtgctaagtgatcaggttgtagggattccactagctgcccaagagcaattacactgttacatgcaactggcggtgcggaagtcctttttgcctaacgctaatcagcagcggtgcattgacgtcctacgtcaaattagacgggctaattaggtcttcagcactaatccaaaaatagcgctcgcattgactttttcagtcaacgcgagcgccgtcaaatcattattgagctaacattttttgagcgaattccttaacgagttcaatctgctcatctttgagcttgccgccagtactgccgatgattttcattcctttgccacccatgacttggtggaagtggccgatgacgggaatgcccttttcggtggcaatctttgtcagggctttgtctgaaaccatttctggtccgccagaagttgtgaatagggcgatttgtttgatcttagtcggatcaaggttcttcataaaagcagatgcggttttgtcgggtttcataaaataagtaccgccgccaaaaaagagtgtgtcagcttgttcgacaggtgtatcgatggattgtgctggaacacctgccacgctagcgatttgttcggcaaatgcttgtgtattgccattgcgagtttgataacgaattgctactgtcatggaaaagacctccgataaattagttgaaataagaccgttctcgcgatgagtaactgctcagggggactggttataagtttagaataatattgtaatatcaattctagtataaatcgttttgaaatcgattacaaaaatatagtgagcgcattcttgagggttaaggctagcttattcgattgctggaatagtcacagcaatctatcgcggttacgcgcatgacgatgttgtatcttaatggttattagcggagcaagcgggattcttgcgggcataatattggtgatgatacgcgattagtgtcgttatcgtcagtaatttaggaggacggcgaaatgccaaaaatatattttttatgtacgggcaatgcctgtcgcagtcagatggcagaaggctttgcacagcaattattgggaccaaactggcaagttgctagtgctggggtggagacacatggcctgaacccactagctgttcaagtaatgagcgaggtgggtattgatatcagtgaccaggtttctaaattaatcgacctgacctatcttaatcagtgtgcagtcgtggtgacgttgtgtggtgatgcacgggatcgctgccccgtcactccggcaacggtgaccaggctacactggccattgcctgatccggctcgcacgactggcagtgttagtgaccaattgctagtatttcgacaggtccgagatcagatcaaagcacgagtgattgatctggcacggaccttgaatgtttcggcaacgtagccgtgcacaatgaacggttgcagtattaagaaaataaatccaattataatgatgcgcatgtaagctaagaagggctggcatgcgtttttattagctaattaaagttggaaccacactttagttagttataattgtgaaccaacacacatgtataaaagctacagtttaatcgtcgtaagactagtacttttatccattactcaaacaaatttagtgggttaatatgaaagcgtagtcaagataaatgaccggtcatcaggttaatgtttactgataagttaataaaatcacaatttcatcgaggaggacgcaaaacatcatgaaagattttaaagataaagttatgtttatcacgggtgcggcccacggatttggtcaagttattgctgaaggcgccgcggatcggggtatgaagctcacgattgttgatatcgacgaaccagctttgaagaaaacgtaccaacatattctcgacaagggtgccgaggtgttgatggttaccgctgacgttacaaaggaagctagtgtcgacgatgcggttgagcaggccatggaaaagtttgggcggatcgacctactgattaataatgccgggatcgcgctacctggtcggatttgggaattgccgactcgtgattgggaatggatcatgcatatcaacttaatgagtcaagtttatgcgatgaagcgcgttatcccaattatgattcaacagaagacccatgcggatattcttaacgtggcttcgattgccggcttagttgatacgcccggaatgccttcttatcatgccagcaagttcgcttctgttgggatgactgaagcgaccgcctatgacttacaacgggctaatattgatatcgacatgcacgtgatgtgccctggctttgttcagacggatctctatcacactgaaaatcaccggccagtgcaatacagcgacccaacggacccgtattatcaaagtgaagcgtacttaaagggacaacaatttgcgaagtatgtcattaccaacgggaaaccaattgatacgattgccgataccgtctttaaagccttagaggataaccgtttctacattttgacccatccagaatataatccactgattgaagaccgagttaaacggatcgtgacggatggtgcaccagacgtgcacatcatggacggtatcatgtaagctagtcacgcaaacaaaggagtgttttaccatggcaagttttattgcaagtgatcaggatgttaagaactttttgacagcaccaagcatgaatgaccaggaaggtattgggtttgcttatgccactgacgaagcggtgcttaaggctttaattccagcaccattaaaattaatggcaccggtggtttgcggttatgtcgttcatatgggaaaaccgacttttagtgccccataccttgaagaaagcctatttgcgttagttagctacaaggataaaatgatgggcgcttacccgattaacctcttactccacggtcccggggcggagagtggtgtgattgcaggtcgggaaggtgctgggattcctaagaaattagcggatgccatcgaattgcgccggaatgacaacagtgcgacagccacggtcgaacgccatggcaagacattactgaacgtttcgtggacggccggtgaactgaatgatccgtcaattatgaaacaatttgcggggcagctcgcgttaggtaaggaagccgaaatgaatagtttcttctacaaatatgacattgatcaacatgaagatgggacgaaccatttcagtaacgtccaattagttgcgactcagttacggtccttagctgatcaagttgaacctgggaacctaagtattcagttggagtcaaccgatgatgatccacttggcgaattgaaggtcttgaagccactcggtgccgcttggttccacttcgacacgtcagttatgttcaacacactgaagttggacgaagttgatgctgcgacaacaatgccaaagctcttaacgggtcggtatgaccggagtttcttcaatcccaaggcagcgacttacattatttaggcggattacgaaagcgaggaatagctgatgtcagaagcagtaaaaaatttggtgaacaatgatttagcagacgtaatgtttaaccgccattcagttcggcagtttgacccgaacgttaaaattggacgtgatgagttacaaaagatgattgcggaagcagccaccgcgccatcggcatgtaatttacagtcatggcactttgtcgtcgtggatacccccgaggcaaaggctaagttcaaacaagccgtgatgaaattcaactacccacaggtcgacagtgcatcggccatcgtctttattgccggtgatacccagtcgcattatgtttatcgcgatgtctggaacaaagtttatgaggatgggaatattacgaaggaacgcttggatcagattctgggaaccttcttaccattatatgaaaatgccacaccagatttcttgaaattcgatgcgacgattgattgttccgttgtcgggatgcagttgctgctagtggcacgggctcatgggtatgatgccaatgcgttctccggaattgactttgaaaagatgattccgacgctgggtcttgatcctaaacgatacgtgccagtaatgggaatcgcaatcgggaaagcagcgcaagaaccgctccatacgactcggtacgatgccaaaacacagactgatttcttagcctaataggtttataaaaagagcgggattcccgctcttttttgtccgaatacgggcctaagaaagctgaggacctttcgaggggggtggtgggttatcagtaggcctctttacaaaaacgcttacattatttatgatgaaggcgacaagcgtgaataaggaggttacttgagtatgcaattaaagccgttattgcggcagttagccacaacgtttgaggtgactgtcgatccaacatttacacataatcccgaagttactcacgtccaatttgttgatccgacggaagcgttagcaagccaccggttatatttgtcccccgactcgagtcagctagttcaacttacttatagttggcacggccatcgtcagtcggtcggactagtaaatctgggaaccggtctgactacaatcattgcggcgcaaaatcagttattgaaattattaatgacgcttggtcagtgtttacaccacgatgttcaaattcaagcagccatcaatcagctcgctatccaagcaatcacggcggattttgataccacactggcccaagcagtacacttattagagaatccgctggcgattattgatctgaacggggagattctgacacggtcgcatacgacgcaactcaatgggactagtattcacgctgcagttgagacgaatcgagtcggacgctggctgttagaccacggatttgcaccggatacgccggattttttaacgcaagtctatgtggcggaagatcagttgtcggcggggcccatgctaattacgccgttagcaaatggcaccgagccgatcggttatttggtgatgccagcactcaataaaccactgaatgatcgacaagcactactgatcaattcgattggtcaggttatcgctggctcgttagttaaaaatcagattatgccaacagctgaatcgcaacgggaccggttattaaacttattattgacggaacatcaagggggaacgtttgctgatcagtttgctgaacaacacgtgcaattaccgacagccatggtgttaatccgctgcgaaccactagctgatcaagcaccgatgattttacagcagcgactacagtacttgatgatgccacgattcaaacaagtgttggtttcgacttatcagcaacaatgtgtggcactgatcccaattaatctggtcgcatataatcagaatcaattcaaactaacgttgcagcaaattacgaagcaagcggattgccgcttgatcgtgtctcagcactacgttaatccggaagatacctttgccgcgtatacagtttgtgaacgaacggcgcaactgaagactggccgtggtcgggtgattttttgtgaagaccaattctataatcttgcgttggcacgagttaatcaccttgagatcttaccgttctttattaatccagccctacgtttgttgttagcctatgatcagcaaaaccatacagaactggtaccaacattagatgtctacttacgggcgacttgtaatttgacccgcacggctaagcaattatacgttcatccaaatacactgcgtaatcgactgcaccatatcacaacactgaccggatgcgatttacgggatgcggaaacgtgctttaaattggctgctagttttaaattacggcaatttttaacccagcatcagtaccagtatcgaccggatattccaattccgacccaagattaagcggggcataaaagcgtgcaaccgtttgtggaaaaatggttggaacagtcattattagtaaatccgtaaattcaggatggacggcagtaatggggccgccattgcgatttgatcggcgggcaggcgtgtgattggcaacaatcgtcattaaaatcgctatgcaaccggttgcattgaaactgaaagcgttttataatgttaagtgaacattaacggtgtgcttcaaaacaagacgggtagccgtcactcttggcgcatctattgatgattgcgcagttgtccggtacccagcaatcaattgtgttggtaattaacgaggaggaaccattaatgagtaaatttgcagatattaaagggtttgtatttgatttagatggcgtgattgcggatacgtccgtttatcactcacaagcttggcatcaattagctgacgagttgggcgttgcctggagtgaagaacttgccgataatttaaagggtgttagtcgaatggactcgttgaacttgatcttaaaaacgggtggtaaggaaaacgactatacggaagccgaaaaagtggcttacgcagccaagaaaaatactaattatctgaacctgttgaagggaatggataaaactgcaattttacctggtatcgaagacttcttggctgatctcgccaagcatgggtatcgtttatccttggcctcagcttctaagaattcaccattggttctggaacagttaggcttggcgcattactttgaagcccgggtggaccccgcaaccttgaaacacggtaagccagatccagagatcttcgcacgtggcgcggaagtgcttggcttgaagcctgaagaatgtgcgggcgttgaagatgctaaggtcggtattcagtcaattaatggtgctagtgaaacgtcgattgggattggtgatcctgccattttgacgggtgcggatgttaacttcacttcaacgagcgaattaaccttagctaatctaaaagccgcgttagcctaagtttaaataatacgaaaagcttacgtcacaaagtcaactagatttgtgatgcaagcttttttgagttactgcttttctgaaagtcttaatgggccgctggcaaggtggcaacatcgggagttagtaactggacgtgtggggtgcgactaaggacgtattctaacggaacggtctgtttttctaataaatgatccgttaagttaacttgctgaatcactcccggattttcgtacagttctagtgcgtacgtttgatgattcaaatccatgtagctacggtactcagtataggttgcttggccgttggcggctactttggcgcccttgggaatagtcacagcattcaagatgtgttgaagtaagttgactgtatctgttgttgtcgctggcacttgcgcatagtgtttcaagaagacggtccgtgcaaagcgagacatcgaagtatagtcaccaggtagacttaatgcgcccgtaccaggtccctgtgaaccaggttggtagttaatgaatttatttagtggtcgctcggtgttagtcagggtgccatacttacttaagttttgtagctgccatttgaggtttggtgaattggtcaggacgccgactgggttattaagcaggcgaagctcgccgctagttggttccaagacggcggtttcaccggtttggtcactgatgataaagtgaagtggtggaatttcgttaattaattctgccgtgctactaattaattgaacgtctttgacgcgctcacgtaggtcagcaacactggtgatttttccgagtacccaggcgacgaaatcgtggggtgcgagatcgattttgtcttggttactgtgaggctggtaaattgcatgattcggaaagtagagtgctgcgatgctgacaccacattcgttaacgccgtccgtgaaaatttcatggttcagttggcgacccgcgccaataaagccataagtcgtggtgaaatcaccaaggtcacccgtcacgcggtaatgtcgaggcatgaacataatacgggtctcaaagtcaacgttaaaatccattgtacgagctaagaagtggcctccatgactatttgtataagttagactagtgcacatacaaatcgctcctttattagatgataccggtaacttatcatatgattgcggatagcggcgaaaattgtgacgtttaaattaacgaatggtaatcaagtttacttttgagggggtagttcaattaacaagctggggaaactcatcatgaggctaatgtttcacgtgaaacattatgcttttaaaatgacaaaatcgctatcataaatgatgttagtagcctaaaataagggggaaagctactaacataatggacgatctaagatggaggaagaaatgaataaagagcgtaagtcggtgatgccgctatcacaacgacatcatatgacaattccatggaaggactttatccgtaatgaagatgttcccgctaagcatgctagcttacaagagcgaacatcaattgttggtcgagttggtattataatgttgtcgtgtgggacgggagcgtggcgggttcgtgatgcgatgaataagattgctcgcagcctgaatttaacgtgctcggcagatatcgggttgatttcgattcagtacacgtgttttcatcatgaacgtagttatacgcaagtattatcgataccaaatactggtgtaaatacggataaactaaatattcttgaacagtttgtcaaagactttgatgcgaaatatgcacggttaacggtggcacaagtgcatgcagcaattgatgaagttcagacgcgtcctaaacagtattcgccactggttcttgggttggcagctggcttagcctgtagtggatttatcttcttacttggtgggggtattcccgagatgatttgttcctttttgggcgcgggtcttggtaactatgttcgggcgctgatgggtaaacggtcgatgacgacggttgccgggattgcggtcagcgttgcggtagcgtgtttggcttatatggttagttttaagatttttgaatataatttccaaattcttgcccagcatgaggcggggtatattggtgccatgttattcgtgattccgggttttccgttcattacgagtatgttggatatctctaagttggatatgcgctcaggactggagcgcttagcttacgcgattatggttaccctgattgcaactctcgtcggctggctagtcgcgacactggtgagcttcaagccagctgatttcttaccgctaggactttcaccgttagcggtacttttattacgattaccagctagtttttgcggtgtttacgggttctcaataatgtttaatagctcgcaaaaaatggccattaccgcgggatttattggggccattgcgaatacattgcgccttgaactagttgacttgacagcaatgccaccggccgcggccgccttttgtggggcgctcgttgccggcttgatcgcatcggtggttaatcgttataacggctatccccggatttcattgacggtaccttcaatcgtaattatggttccgggattatatatttatcgtgcaatttatagtattggcaataatcaaattggtgtcggttcactatggctgacgaaggccgtgttaatcatcatgtttttaccgctcgggctatttgtagcgcgtgcgttgttggatcacgaatggcgacactttgattaattgagtctatcaagttagcggttaaaaagtcatttagtcaccagatcagttaggtctggtgactaaatgactttttaaatggcctttgactgaaaatttaacggtgacagtttacaattaagttatcaatctagcagggggcttggtcatggaagggattactaatttacggtcactaggtggttatcgcaataaaaatcagcaagtaatcaaagatggtttaatttaccggtcaggacaattggatcaattaacaccggcacagacgcagtatctagcaaccacgcttggcattacgcgaatcgtggacatgcgtagtgctgatgagcgtcatcaatttccagatgcgacatggccacacgtccagtatcacgtgctggatgtgctagcacaagtcatgacgaacgacgcaagtttacaatcgatgattagtagtacgggggcggtccatgaccgcatggttcagttatatgaacagctagcgttagatcctactgcccgtcaaagttattgtcaatttatacagctactactggttccagatcagccactactgttccattgttttgccggtaaggatcgcaccggcgtcggggccgccttatttctaaaaattttgggtattagtgacgagcaaatcatggctgactatctgctcacaaatcaagcacgtgcggctgctaatcaacaaatcttggcgacgatggcgtcgcaattatctgatgagcaacaacgggccgtgaaccaggcattattagtagacgctgattacctgagccattactttgaagtcatcaaagcccggtacgacacattttcaaattacttgcagacgggtctagggctgacctcagcggaatgtcaacagttacgcggattatatttgactaaatagtcaataatataaaggcgcaaaaaatcacaccaatactcacttaaggactaacctgggtattggtgtgattacttattcatgggtgtttgcgttgtccgctgacaatagtcggtcaatcatctgattgccagcctgtaaatcggcgcgttgataatgttgggcacgaatacgcattggatcaccaccatgatagtattcgtacatcaattggcgctgaccaaagccagaacttgttaaatcgaaggctaagttcaacaagcgcgtgcgggttttagcggtggctcggtccgtcgtgagtgcctggttgaggattgtcgcattatcgccgtcaaattccgcaaaacttggcacgccaaccatggaaccggccgctaagtgttgagtcacgcgcaaggcctcgtcatagtattcgggaagggtcgagcgaaccgcttgcaaagcttggagattgggcgtatagataccgaattcgtccagatgaccgttgtcttctgaacgggtgatggtacccttgatgagttccagattagcggttaaccgaccgagtttttcttggacacctaagaaaccatctaatcctaagatatgagcaatccgaagcgctaaactggttgctaactcaagcttagtaatacctcgaacctcatcttgatgggaagtctggctaaacatgcctgaatcgatgaagaaacgattactcatttcaacattattttcaacaaatacttttgaccacggaataaaggcgtgatcaaaaacaatgtaggcgtcaatctcatcaagggcgttgctgagtgggtaatccgtaatggaagcggtgggatgatctaataatttgcgacaaatgatcttgacgcccggattattgagtggcgtagcaaaggcgacagcataactactatcgccgttttctaacaacagttccggcggattaaaaatcaggaggtcatcagcaattggggccatcgtattgaccattttggcaccagaaacgaagattccatcttgattacgttcaatggtatgaacacccgcgtatccagacggaatggcattgatggctttttgacggttgagttgtgggttttgaagcgcatggctaatgaagatatcgttagctttgacctccttagcgtaattgcgggcattagctgcaaaatcagtatattgattttgcccgaggaaggcagcgcgttctgctaagacggccatcccagtattaagaaaatccggtgtgcggcctaacatgccgctgttactttgcgcaatttcttgataagcacggtgcttttgttgtaaatcagcgacggtgcgtggcactttgaaagcaatatcgtagcggtgaccattttcctgataagtatgtacttcgggatggttgtgttgcaggtcatagtactgattattgagtgctaaagttttacgaaaaatgggcacatcggcgacattgacgcggtgaccatttagatagaccgcgcgcccgtcattgagttgttcgatagtatgcatgtgtcgttccccctaatgaaagttctattccaatataccactaatggaagcgaattcaccagtgccaattggaacgctatttttagtgaacgggataaacgacgtggaagcgttccagaaccatttgtgcagtatggggatcaaagcgctgatgctcgctttggtactcctgcttgaagaaggcatcatgaacacggcgccaataggcataagtacgatcgccttcaccttctaagtaagcgtgggttgcatcgatgtccaagtaaggcgtaatcatgacttgatcggtccgggtcacacagacaggctgattatgagcatctaagatgacgtcataagcgcccacttttggcagtggttcatcagtttcgtataggtcataagcgctggtggtagccgtttttgtgccagttagtacgagctgtgcaagtttatcaggatcgctgccaaactgataagcactttgtaatggggtactttgtgtcaatttgagcgtcgttttagcttgttcgaaaaaagattggacgtccattattatcacctctaaattatgatcggttttaagtttaacataagcgcccatggctcaagtaattagcgtggtataatgactctatcttgggtaattgcaggcgatacccagaccaaacattgccgttgtggaaaggactaatcatgcgaattaatgtgttgcaacatacccccaatgagggccctggaatgattgctgattgggcgcatgcccatggtcataccatgtatgtctatcacccgtatcaattcggtgttctcccaacggcggatgagacggagatgcttgttatcctcggcggaccgatgagtcccaacgatacgctgccatggatcaagcaggaacgagacttgattcaacaattattggaccgcgatatcccaatgtttggtgcgtgttacggcgcgcaacaaattgcgaagaccttaggatacccagtcactaaggcgccagctaaggaagtaggttgggcaccgatttaccgacagagtcctgtgattccggggattccagcaaaactgtcggtcttgcattggcacgaggagatgttcaccgttccagccgaagcaacgctgttgttctctagtgatcgtgtgaccaatcaaggcttcgtatggaagcatcgggtagtggggttacaatttcactttgagccggctgcggacaatgttcgtgagatggtcgtcaatgattatcggtatattgcggggtcggtcctaaaccaaacagcagcagaaattttacaaacgccggtaccacgagagaatcaacaagttctgaatgcaattttgaattatattacggctgaataaagcagttaagaagagaataagcaggttagtaaaaatgtcggtagtccttgacggggctaccgacatttttgttcagaaaaccaaacgttaatagaagccttgaatttgctgcagttcttgcagataggcagtttttaacgcttccggataaataattctaacgttacggccaagtcccagtaaatagtcgaccatataggctaattcatcttgattataaccaccaatgagataatcttggtcgttctgatgtgttaagtgcatattaggataattattcttttgtacatgttcacggcctagaggtgttagtgcaaatttataacgtatattgtgatgatggtgatcgtaggaccgttgccgttgcgcgagctgtttccaagtataccgtgctggttgctcactggtttgaaatgctttgatcgtgtcacagcgatagatgccccaagcattgttatcgagattgacgccactgaaaaaccaaatgccatgccgatataataaatcaaaaatctgaaacctagttgtcacagtagtcatcgttaactggacaacattttcatcaaggatagccgttaataaatcacttaaatgggttggggcatccaagttaggaattgagtagtagttaaccacacgttgcaatttggcgacctggcgctggttgcttaaagatagtgttgccatgagttttttgtaaattgtatggtaggacttttcaaagggggtcgccgacaataaactgagtgctttgagcgcaaaaaagagcgcattaatttcctggctgtttaataagatgggtacccatagttgttgttgcatgagttggtagccaccgtaacgtcccggttcaacgtaaaaggacaaaccaagttgttctaacgagttaacgtcgcgcaaggcggtccgtttggagatattgaattcttgcatgagttctttgatgtggaattcttgtcggtaactgagaaagatcaattcttgattaagacgttcagagcggttcatataaataactcctaaaaatgattttaatggtgacatagattggcacctttcgactgtagtatataactgttgtcaaaaacaaccaataaatatatttattaattaaggagatatttaaatgactaagactttgattattaatgcacatcccgattttcgtaatgcggcgcactactcagttcaactagaacaaacctttttgcaactttttcagacccgctttcctaatgatactgtggatgtgctcaatttgtatgatacggtgattccccaagcaacggtacctgaattgctgggaatctgggaaaagcaagcgcaacatgtaaatttatcgattgaggaacaacgcctgtttgcaatcaatcagcaactcctacaacagtttaaagctcatcatcggattgtgattgcgatgccgttgcataatttcaacgtgccggcacggttaaaggactatatcgataatatcttagttgccagggagacttttcgttataccgaaaatggatcagtgggtttgatgaccgataattatcgtgtcatgttactgcaggccagtgggtcaatctatactcgtaatgaccgttatacacccatggaattttctcggctgtatcttgacaagatgtttactgaaattatggggtttgaccggtttgagattgtccgtgcacaaggactgcaaacgaacggggtggcggtatcacaggcattaaagcaagccaaaatggacctgaaggcagcttttgagcgtttttatgattaagtctgaaaatgattttaaggtatcggtagttgtaggctacggataccttttttgcgatactgcacgggaaatgggtcaccactactttaaagtgatcgcaactatggaaagtaactagcctgattttggtgattaacattggactaaaacacgccaaaattcatgcatatttaacgttagtggcagacctttactagccgttcagtgctgagaaccggtatactggaagcagtgattcactaatcgtgaagggagcccaatatgaaacggattgtagcgggaattattgcccacgtcgatgccggtaaaacgacgctgtcagaagcattactataccggtctggcgcgctacggcaattagggcgcgtcgataatggcgatgcttttttagatacggatgtgcttgaaaaacagcgtggtattacgattttttcacaccaagctaatttacaatataaagacattaatttaatactcttggataccccgggccacgtcgattttgcgacccagactgaacaagtactgtcggttttggacgtcgcaattttagtcgtttcagcgactgatggtgtgcaggggtacacgcggacgttatggcgattattagcccgttatgacgttcctaccattctgtttgtaaataagatggatgcgccggggacggatagcgaccaattgatacaacaaattcaacagacattatcgcctggttgtgtggcgtttaacacgccgggagccggggacacgttggaagatcggccagtcataccgactgcggcagttgaagatattgcgatgcaaaatgacgaagtgttaacggattacttagaaacagggacgttaagtgatgccacgattcggcagatgattcaacggcgggaagtttttccgtgttattttggcgcggcacttaagctggacggggttgatgcgctaatggctggtcttgattattggacgacgccacaattaacgcgtcctgaatttggcgcgcgggtgttcaagattacgcacgatgatcaaggtgaacggcttacttggattcggatgaccggtggcaccttacgacctaaagatatcgtgtatgatgaccaaaaagtcaatcagttacgggtttacaacgggactaagtatgcgaccacgtccgcgctgacggcaggatccgttggtgccattaccggtctaacgggaacgcggccggggcaaggattgggacaggcagcaactagtctacaacccgtcatgcagcccgtactgacttacgcacttgatcctcagcgtgaggagttacacacctgcttagcagccttgcgtcaacttgaagatgaggatccacaattacacgtgacttggtcagaaccacttcaggaattgcgagtacaggtcatgggaacgattcaactggaagttttgcaacaaatcttgcaggatcgttttcaactgactgtaaagtttggaacggggagtatcttgtatcaagagacgattacccaagctgttgaaggtgttgggcattttgaaccgttacgacactacgcggaagtacatttgttgctgacgcccgcaccgcggggaagtgggcttcaatttacgaccgattgttcattggaagtgcttggccgaaattggcaacaccaagtcgtgtcaaacctacaagccaaaacacaagtgggtgtcctgattggcgcaccactaacggatgttaaggtaacactggttagtggtcgggctagcaatgttcattcggttggtggtgactttcgtgaagcgacgtggcgcgcgttgcgtcaaggtttgatgatgttaaaccaacgtggtgattgtcagttattggagccgtggtatcggttccgtctagaaattggtcaggaacaagttggccgggcgatgactgatattcagcggatgaatggtcagtttgacgcaccggtcgctaatacaagcgtagccacggacgggactggcctgacgacaattacgggaacggcgccagtagcagcgatgcaggactattcacagacggttcgagcttacacgcatgggcaggggcaattggaatgtatcgtggatggctatcggccgtgtcataacgagatggctgttgtcgataaggccgaatatgttcccacagcagatttagaaaatacaccggactcggtcttttgcgcacatggtgcgggttatccggtagcttggaatcaagtgccagagatggcgcatgtcccgtacgtttattcgaatacggaattggcacattttaaggcgtcatcaaaatagaaattgaggaaattcagatgatggatgtgacgtttaattcgacgtttgcggtaaccttgcaacatgagttgcaccagccagtattgagtttgccattgtcgctacaaatcggtgatttaactcgattgacaactgatgatccagcacagcttgctatcatgtcacacagtaccgatgccacggttgtcaagcaagcgttggtaacattaaagtctcaagttgagcaggggggcgtgctacgagtatggtggtctaccatgcccgatgattggttaggatacgactggttgtgtcagcagttagcagacacagacgcgcaattgagacaagtgatggtaccgctaagtcaagtgataactcgaccaggtctagctttacagactttgtcggatttatcggaagtattgccagcggatattgcgcattacttacagttggcacaagacgtttctaaggacgaacaacgtgctcatagttatgaatggcaagcgctcgtggtagaaaatgcgccgttacgggtcaatcttaacgggcacttagtcagtgtcccagctgacttttatgacagcttgttagaacgccaaatacaacagggacgcccaattgtgcaaattattggtgagatgctgatgcgctactcactgggcttgccagactggtggtatcgtgcccggctccaacatatcttgtcaacgagaggatgattaatgtgaagaaaattgcgcccctgttcgttggcttaggggccattagttttggaattccggcgtcactatttaaaattgcgcgtcggcagggggttgtcaatggcccattgctattctggtcctttctgagtgcggttgtgattttaggtgtgattcaaattttacgccgtgcacgtttgcgtaatcagcaaacgaattggaagcaaatcggactggtaattgcggctggaacggcttcgggatttactaacaccttttacatacaggcgttaaagcttatcccagttgctgtggccgcggtaatgttgatgcaggcggtctggatatcaacattactaggagcagtgattcatcatcggcgtccctcccgactgcaagtggttagcattgttttggtattgataggcacgattttagctgctggtctgtttccaattacgcaggcgctctcgccgtggggcttgatgttaagttttttagcggcatgctcgtatgcttgcacgatgcagtttacggctagcttaggcaataacttagacccgttatcgaaaacacggttactgtgtttgggcgctttcatactcattgctatcgtgtggtcaccgcaattagttacggcacccaccacgccagcaacagtcggctggggagtactgattgcactattctcaatggttttcccactggttatgtattcattgtttatgccgtacttagagcttggcattggcccaatcctttcttctttagaattaccagcctcgattgttgttgcatttgtactgcttgatgaaactattgattgggtgcaaatggttggcgtggtcattattattacggccgtaattctgccaaacgtgttaaatatgcgacgagttcggccatagttcaggtcaataccaaactcaaaatgaacatgttgtactggattcatttttgtactgagttttttgtttcacgtgaaacattcatctaattgatgctctttatgaatagttggtgggtaccttatttatataaatgataaaatgtgcctcacttagggacaacttgcattgaaaggtggtcaggctgatggcactaacctatcggatcgtccgcgctgaagcagacagtgattttggaaaaattcgacagttatattatgagacctggcaatcagcatatcgtgatttgatgcctgcaagttatttacagcaattgacgccagcaacttggcggccggaacggcggtggcaaaatatgttgctggcaatgacggctgatggtgaagttgtgggtgtttgcacatttggtccggccagacatgcgaactatgaggggtggggcgaactgtattcgctatatgttcacccgaactatcatcatcatggcattggtcagcaattaataatccaggcccaccgtcgcttaaaggcggtctatccacagaattatctacttgttctggcaaataatgctgtggcccagcgtttttatcaacgtaatggatttcacgacactggtcagatttatgtcgatcatgcgccgtttggtgttttgcatgagcggatttttgaagattaacgcaaaaaaacgagccttgtgctcgtttttttatagtttagcaatcaattggcgtgcgaccgcgcgtgctgagaacggattttgaccagtgatcaattggccgtcagtaattgcatattcgcgataaaatcgatgctgactaaagatagcaccgtgagcagtagctcgttcacggttaaggaacgggacgatccgttttttgccggcaataagctcttcagttgcggtaaagcccgtaatggttttgccagcaatcaagtattggcccgtttggtctttgatgtttaggaggccagcaattccgtgacaaacggaggtcacatatccaccatgttgataaatggccagtgcgatggcttgtaactcagggttgtccggaaagtcccacatcacaccgtggcccccggtatagtaaatagcagtgtaatcatcgggatcgacctgactaggcttgagtgtgttcttaagggcccgattaatgaagtcagaatcttcatacacggccattgtggcggcatcggtatatttcatactacgcgggtcaaggggcacgaagccaccattaggactaacatagtcaacggcaatttgggcttgctgcatttcatcgacgaactcagcggcttcacctaaccaaagaccagtcggctcattagttccttggtaacgagtgatattggtttcgacaattaaaacttttttcattgatcatgactccttaaaaagactgatttgaagtatattagttagctaattaggttgaatactgataatgattttaccggtagcgtgaccggaatgcgaatattctaacgcggcgttgatgtcggtgaggggaataatccgatcaacaaccggtttaataacgccctgttcaattagttgtcgcaggcgcacaagttgctggccactaggttgcatgaacagaaacgaataggtagcctgggcttgttgttccagtcgactcagtttccgcgttgctagacccaataaccattgtttccatattggcagtccgtaatccttaccaaaacgcgcgtttggcagtccggcaatgctgacaatctgaccgcctggtttgataatctgaaaagcggcctcgagggattgcccgccacgagtatctaatacggcatcgtaatgggataatacatcagtaaagtcttgctgatgatagtcaatgattttatcagcacctagtgattgaacgaggtcaaaatgtttcgcactggtagtggttgcgacgtaagcgccgaaatatttagccagttgaatggcaataatcccaatgccacctgaaccgccgggaatgaaaaccttttgtcccggctggatgttcattatatcgtgtagcgcttggtaactggttaaacctactaatggaattgcagcggcttcttcaaaattgagattggctggtttcagtgcgatggcttgatgatcaatggcgataaattcagcaaaggttccaattcgatcttttggtgcgcgaccgtaaacagcatcaccaactttaaagtccggtacttggtcgccaacggcagtaattacaccggcaaagtcactgcccataattagtggcatggtgtattgtagtaacaatcttagatcgccatctttggttttcaaatcgattgggttgacactggcggcaacgattttgacgagaacatcggtgggagctattgtcggaacagggacttctgtcaccatgggggttatttgcttgtatttagtaataatggcagctttcatagtggactcctaacatattagtttaaatgtttaacatcttgaacaaatcatgctgttgattctagtcgcttacttacaaaaagtcaacgattaattcttgactttcaattttagcaagcgttaaatggtttaagaatacgaaccgtaattggaaaggtgtgattttttggcagaacgaacgatggcaatatttaagaagggtgttccgatttttacaattcttcaagacgaaaatcggcaacggattttggtgatgctgtgccggactgatcagatgacggttaaccaaattacagcgcaaatcgccttatcacgaccggccgtatcgcaccatttgaagttgatgctggatgccggcattttagcggttagcaaaacaggtactgaacgttattaccgcgctaacatgacggcgactctaaaattattgaaggcactcactgcgtcattagaagccgatttagcccatactcagtctgtagacgaataaaaaaatgaatcagagtgaaaaaagctggtacttttggaatgacgcctctcattccaaaagtaccagcttttagttcacttatgcagttcagcgcactgaatcaccagtacctgaaatggatggcgccatttaatgattatcagtgagctaacgacatgatatcgttattattaatttgaggatggtacttgaatatctttgaaggtgtgccgataaagtaaccagccaagtaagcacgttaagacatcagcgaccgcttgagcccaaataataccagttagtccaaagaactgtgccagaataacgatggcgatacctagtaagattgcttgccgcgaaagcgccatggctagggcactcaaacccgcaccgactgattgaaagacggtcgtgaacacgaggatgaagcccactaatggtgtcgtaatcaacattgctcgcaacatttgtgtacccatagtgacaatgactggttgattcataaatagtttaataagttgaggcgcaaaaatcattagaataatcgcacaaatggttgcgtagccaccttcgacttttaaatcgaagcgcaatgttgcccgtagtctttgccaatttttagcaccgtacgtgtaaccaactaaaggctgggccccaaaagcaaagccgaccatgaccatcataacgaccatgtaaactttttgaacaattcccatggccgccacggcttgggcgccgtatgcggctaagtagctgtttaagatcatcatgccaaaactctgggttaggttagtcagtgaggctggaatcccaaccgcgacgacggctttaagggttggtcgcgagatatgggctaactttggtgctaaggagagcgttttggctcggcgcataaaaaagactaacagactggtgttgaccgcgtaccccaaaacgttggaaaagcaacgcccgaagcaccccagtgaaagccaaataagaataagggatcgagaataatggtcagaaccgtcccactgatggtcgcaatcatggaaagttgtgccagaccctccgttcggataatgttaccgggaaccagtgaaacaatgataaaggttgatcctaataccaatatacgatagaagtccgcaatgtagggacgggtagctgcagtagcacctagcaagcctaaaattgggtgttcgaatagtaataataaggctgtcagtactaagctaagtgcgatcgcaatgtaaaaacaaaagctactgatacgtgcactttggtgataatcatgacgaccaaggactcttgaaataacggcactcccaccgaggccaaaaatatcgccaactgctaacataaacgaaaatagcggactgccgagggcaataccagcaactaaatcagcattaccagtttgagcaacaaaaaatgtatctgctaagttataaatcatgctggcaaccatgccaagaaccacaggaaaggctaaatgaaaatatgctttgggaatcggggccttctcaaataaatcattcataaaaataagtcactccttctctgaacagtcggtcgaagcgtgactagacgaacagaaagataatataagttaatgatacgcttgactgtcaagctgctcaaggtgacaatctgggaaggtcagttagctggaggaacgacaaaaaagcattgcctagtgttattaacagcaatgctaaaaattaacgtgaatttttaagagattaacgtaagtcgatttggtgaaggttagccggcatctgaccaacatgatggccgaccgttcctgcgtgcatcgcttgtgcgccattgataaagtgcacaccagtggctgcaattaatcccattcctaatactgtaataatacttaataccatcattattcacccgtttctgattatttctgcacttctattgtagcgcttacatcaccattgtcatttgagttgtattagaatggaattaagtttttcactttttcaggtagacattaatattgggatggaataagtaccattgtgcgagttaatttgtcatcaatcatgattaaaacgtgccattttttaaattcaaaagcagccagcttaggttcgctgagaacagttcgagttagcgtaaacttgcttagggtgcgcgtcctacaccgacttccaggcatttctgccaattgccggaacgtggtgggcacagatttaagccgaagcccacgtcttaaatactggcctttcactaaccaagcaaaagacgcttgctaagtgaaatttcaccactgggcattgtcagaaacgccttccagtcgggacagtattcgaatggcagacagtaagggacccaacttttgttggactcatcattgttcttcataaacagcaattttgtcgagcaactgtcaggtagaaaatgacattgtgatagctcactatttcggaatcgccatagtaataatcgaacgtctcaacaaagtggttaatgtaaccctaacgtttcttttaaggttccatcatcaaaatagtcagcgaccaattgtaccaagtttagtggccgttcaccagccattcgagcggcttaccgactggaggggctgggtgacaatgctcagtagccaaattattcttagtcggaagtgggttgcttccggcttagaataagactcgtatttgagactgggcgggttgtgcacgggctctaatcgacgtcggcttacgttccagcaattgtcacccagccccggaggccggaatcggacacgcattgctgacgaacaggaatccatctgtttggcacgttttaatcaaggctaatgctaaatagcggctagcataacgcataacgcgtaacaagtaaaaaattagtaacgaaagtgagtgatattttggacgtgcaagaaggatacatgccatttaatggttatcagacgtattatcgaatcgtaggggatcggcaatcaaataagacaccgttagttttgctacatggtggtccaggatcaacgcataattactttgaaggatttgatgacctggccgctcaaacgggacgaccaatcgttatgtatgatcaattaggctgtgggcgttcatcgatacctgatgacgatcaattatggcaagccgcaatgtgggtggcagagttgcgggcgttacgtacgtatttagacttacccgagattcacttactagggcagtcctggggtggtatgctagccattatttatggttgtgactatcggccgcaggggattaaaagtttgattttagccagtaccttatcttcagcccgactgtgggctcaggaacagcatcggatgattcggttaatgtccccagtggatcagtcggctattgcgacagcagaacggttacaggatttcacaggtgctgcctacctgactgctaatcaacattttatgacgcaacatgcgtcgggcccgattactgctgatgatcctgaattcctacggcgatcaaaacgggtggggaccacggcttataatgtagcgtggggtcccaatgaatataatccgactggtacgttagcggattatgagtataccgaccgattacagtatttgcagatgccaactttagtcaccagtggaacggatgatttgtgtacgccattagtcgctaagaccatggtcgaccagttacctcatgcgacttggacgttatttccccgtagccgtcacatggcgtttatcgatgaaaacacggcctatatgacgcgattgcgtcactggctagcagcccatgattagagaaatgagcgtaatcatttcccgggaaataatttgctgaatagctcgattgagaagtttatcggcgtgatctgattttgtttggctgtcactataatggctattaaagggtttaaagtagacaaaagcgcctgtggaagttagtcttctgcgggcgctttggtgattgctgtgatgatgtttaatgttgatagataaagacgaatcgattgaccgtcgagcgcttttcgtcaaattgataatcgggatggtcaaatgtgcgaatggccgtcacatcatcgatttgatgttcagccaaaaaacggaccatggccccacgtgccatcttagctaatgtggctttagtcttgagtttaccgtcgataaggcttgcaaagacaatatcaatcattgattgatgcggagccagataaggtgcaatggtcttagcatattcttgagaagcaagattgataattggttctggccgcggagtcagtgcctgatagaggcggttgccccaaaacgcatagaggttcttggcttgaccaacagccaaccgtgcttgcatttctaaccgataaggaacgataccatcaaacggtcggagaatgccgtaaaagcctgacaagattcgtaagtttgtctgaatatagtcaagggctggctgggtaaagacgtccggggccatgtaacggtactgaataccgctgtaactgagaatagcggtattcagattgcgggtcaggtcaattttttgaagccaatcataattaggttgggctagtttgtcactgcaatgccataaggttttggcctcaggataggtgaggtgttgcagttgggccagaaaggcatcttggtcgataatcattttttttgcaggtgcaatgatgattttcataaggtcactactttcgaagcgttcagtttataaataatgttgatagcatttaaagcaaaaactaagctatagaaatatgatagcacattagacaaacgtacgttcctaaaactatcaattgcggtataatgaaattatgatattaattgagtaaaaggagtttgtcggtatggatatttcactattaaaacaagtggttcggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccgttcaatcaactaataagattgctctcagcacggccgtcaataatgaagcggatgttaaaattgttaactttgtctggtacgaagcacaaccagatacgctatacttctcatcagttaagacgagtcccgctttgaaggtttatgaccagaatccggatattgcattcattacgattcctaatgatggaacagcgggcaatccatatctacgagcccaacacgttaagttacaacggtcaactaagacgatgaccgacttgctaccccaatatttagaaacagttccgaattatcaacaagtctgggatgctattggatcgacactcgttgtttttgaattgcaactaactgatctttttgttgacgcgggtgttggtggtgagaagcaaacactgacttttaattaacactggattcctatactaaaagcgtttcaaggctggcttaggttaagctacggtcttgaaacgctttttggtcgggtaattttaggagcaacatatgaggcgttatttcacatatgcggtccgataattggcggcaccgctgaaattattatagatgacgccctttaagtgcgacttaacgagcagatgggaacggccttcgtagagtggggtcacggcctgatcagttagcgccgttttagcggcttgaactaagtcttgatagcgcttggtcgcgttcaaagcatctggaccatcagcggcttgcattgcctggtcgtaagccttgctttgatagtggcccatgttggagttgctgtcgccagtcaaaattgttaatgattgtgaagggtcggcaaaatccatactccagctagttaaattaagctggaaggctcccttggaaactttacctagcattgcggtaaatggcattgccttgattgttacctttagtccggggaggtgactggttaattgtccctggatgaattcagcgacctgatgtgagttgtcatcatcaccacaagtaatcgttaacgttagcgattttttgcccaattgtcgttgtgctttatgataggcggctcgagcctggttgagattataattaacagtaccatcaacggtcgcatcattgacaaaatcggtaccagttttaggattcttagccatattgcgcacaccaaagcttttggctggaagcgaaccattttctagaactttgttggtcagttgcgaccggttgattgctaaggataaagcggtgcggagttcacggttggctgctacatggtcatggtgattgtattgaataaagctgatttgaccacccgcaagtgttttgagttcttgattatttttattctggacactctgctcgccattaagtgtcacactatctaacttattagattgatataaattataggcagtcgtattggacttaataacctgataattgatttggtgcagtttcaccagtttgtgatcgtaataagctggatttttctttaaggtccacgtattattagtcccggtccagccagtaagcgtaaatggcccgttgtagacggtcgtcgcggccgaagtcccgtacttcttcccgtatttgttaacagcaggttgattgaccggataaaaggtcgaaacagctaaaatctttttaaagtaggcgacaggtttgcttaacgtgattgttaattgatagtcaccattagctttgacaccaagggttgatggctttttcttgccggctgcaatggcgtcggcatttttaatgtttgtgaagacataggtgaattcagatttattttttggatcaagagttcgtctccatgaatagacaaaatcatgagcggtcaccttgttaccgttactccagcgcgcatcgtggcgtaattgaatggtataggtatgaccaccattggtgacagttgtcttagtagccaaagcgttgatgggttggctctgactgttcagccgatagagcccctcgtcaacttgggtgacttggctattagaaacgctgtccgtcattttagcgggatctaagctcataatttctgagccagctgatagattgataacttgtgattgtttagtcgtagctgggtgcgagtgggcgttgacggtaaacccgatgccgccaataatagccacgctgccgattgttaaaattaatttgtgtgttccggataaactcataattaaatcctccaaaaatataattgtatttggttagtttgatccatgagttttgccatcgtttcgtgaccatttatttcaccccgtttttatcgtcaaaaaaaccgtccttatccagccaatgctgtgttaaggacggtttgataaccgccgtgccaccttaattgagtgttcgccaatttagtgattaaatcacgcgtacactcctactccataggaaactaacatttccctgacaactgacgtatgtcgcacgtctttccgtactctcaactgacgttaatttcggcaaagccctcggtggtccatttaattacctgcgttcggccatactctcagcaacgatgactctctgtgcgggcacgataatcttgatctccacctcattggtttataaggacgatattttgttgaagtgagtataccgcttttgaaaatcagttgtcaagagctggaaaaatattgttcaactataaatttagtcaaacagaaaacgatgttcgtaaataaaccgaggattaatatagtgtcgcgtggcattgattgcgtggcttttaataacggctgcaagcattaattactttcattatgcgcgaataaaaattataatgacatcaataatgtaaacggattcaatattgcggtgacaagattaaggagggctaaacatgagctttagagttgtagccggttatttcggtgaatttagtgatgaagcgaagcgggccaatcaagacttaggtgtaatcggcatgtcgtttcagtatcaatgtaatctcgtttatccagaaggggcggggccaaactttggttttcgaaccgacgcgcaagcgattgatgtgttcgatgcgttaaaagttggttacgatggtttcaaagtgcaagctggcctgattaaggcgatgggactagttgattatcaattggttggtggtcgttacgaactagtcggccatgatttccgagaattacctttagctgagatcaatgcgaacttggaaacgatgcccggactcttggctcagggaccgatgccagttcgatatgtgacttatcgtcggacggatgaccctattgacgcggttggctttagtggcaactgggcactaggagatagcggtggctttcgacagttaagtgagacgttggcagaaccaatgcaagcaccagtggcggcgctaattaaggcaattgatcaacttggtttaacgttacaacaaattaatctacccacaccgcaaagttcaacggctttgccgacacatttgagtgatgatgttcatcaagcgaacgttgacgtgtgggtggtgttaacacagccacaaggtgacgagcagcaagttttgcagaccattcataacgctcaagagtgtaatgaaaaattgtgcgaagcgctgactcgtgtttatttgaagtaggatgtttcacgtgaaacaactggcacttggcagtccgttattttctttagtgcgttgtatgatatgatacgcacgaatcgtaacacatcttcacgggagaaaatatgttattagaaacttatcagcatcgctcatttatcaaacaaactggcaatatttctatcgaacgtgattgggaaaagcttttcgatgaagcgtggttgattaagcatcttcgtggctatcgctaagctcaagacttagaggggagtggtttgatgatgacatcaacaccacggttattacaagccattcaacaaacgaccaccgcaattttaaaaacaaaccttgttggtatttacctgcatggatcctatgttttaggctcatataacgaacaggtgagcgatttagactatctgatcgttgttcggcgttcgttaacattagctgaaaaacggcagttaatgacagctaccataacgcaattgtggccattagcgccacacaagggattggagtttcatgtgctgttactgagtgcaacccagcattttgtgcatccttgcccattcgattttcatttttcaaaataccattatgaggattatcaacggacaccgctagcctacctaaaagcgatgcacggcacggatcctgatcttgctgcccacttaacgattctccaagcagcaggacaagtcttacttgggccagctattacaacggtctttggccccgttcctgcgacggcctattgggacagtatcaagtctgatatcgcgaatgctgaaacggcgatcgttcagttaccaatgtatacggtattaaacctttgtcgagttcgcgcttaccagcaagatcagttaattatttctaagcaggccgggggtgaatgggggttacaacagctgccaacacagtggcatccgttgatcaggcaggcgttagcagcctatgctggtcaacaggacgaacaggttatacgatggtcacgaccaaacttagtggcgtttgcacgaatcatgttagccgagttgggcttaaaatcagaatagtttgtgagtttaacaaaaaatgcttactggcgatcatccaccagtaagcatttttgtcaccaccaacttaaagtcggctgttataaatcaagaaactaatgtagcagttatcgccatcaggtaaatcatagccagtgttttcgttgctaccgtcattttcgtgtaaaacaacgaattcaccagaaccataatcttggtcgtttaaatactttactaaacgttcatcacattcagctaaagtcttaccggtcacaacgcgccggttccaaccacgatggatctcagtatttggattaagcatctcttctcaactcctcttaattataaagtcatcaattgcgcttgccgagcgggttgctgatcaagatcagcgcgcgttaggtcagcgtcgacttggtgggtactgttaaaaataatgaaacgttcaccaacggcttggacttgctggtagttatggcttgccataatgatagttttgccggcagcttgtagccgttgcagtagggttagcatttgctgctgagcggcaattgttaagccgttcagcggttcatctaacaataaaatttcagggttcaaggcgagaacgctggctagtgccacgcgcttcttttcaccacctgaaagttggtaagggacccggtctgctaagttagcacagtccgttaattgtaagcagtcggcgacgcgttgcgcaaccatggctgctgataaaccgagttgtcggggaccgaaagcgacttcctcagtgaccgacgtgttgaatagttgaacatcagtattttgaaagaccatgccgatccgctgatgaagttgttgtcgattttgggcatcagcgagataagtggtcgtaatcggctgatcgtgaaactgataagtgccactagttggactagctaatccactcaatagtcgtaaaagggtcgatttaccagatccattgggccccattagacagacaaagtcgcctgagttgaccgttaagctgaggtccttcaagccacacgtatcaggataatcatagcaaatattcaccaatttaatcaataccacgttaatgcctccaaaaaataaataatatccagacaataatcgctgggctcagggcaagataatcgcgccaatgggtacgacgcccggttgagcgcgcgtaatgaccattgaacccgcgtgcttccatggcagcgtatagttctagcgcataagtgtaacttttaagatataaattaccaaataatgcgccgattaaacggtatggatgagccgttggggcgaccgtccgcaattctagtgcttccatcgtcagcaatagatgttggccgagcattcgtaagtacgtgatggcaatggccaaagtcataattaatagatcagggcaatggagtgccttcaagccagccaataaatcttgaaacggcgtggttagacggtaatattgagcgtttgccagcattagactggttttaaggccaaagaataatagcgtggtgggaccggctaaccagtagctcggtaatacgaacagcatggccatcccaacactgattagccagcttcccataaaacggcgcagttggcgtggaggtaaccataataattggcacccaactaatagtgctaggccccataacagaatgagattattacttaaagcaattaaaatgacgagcaacaggagctgaattaatttgaattgcggtgcaacgcgccaatgagacgttgccgtgactggcgctggctgtgctagtcgactgagtaattggcgtaggtgacgctgattacgttgccaaaatttcgctttaatagcaggtgttggcgtggtggtcgtagtttgcagccaagctggaatatcagtgttgggacgtgtcggtttcatgttgaagacctcgaatcaaaagtaagaaaatcaaaacagcggtaatggccgataaaatataacccacactgaccggtaagcccgcgatggcgtaatcactgaacagggcctgaaaatggaacccgtggaccattccttgaggcgcgtgagtactgatatgttgttgcgctagccgttgctgtaattcttgggggctccattcgccccaagccgtattgctagccaacaagcctaatggtgataacaccgctaatccgagtagcagtgcgatccacggccgctgattgcgccgagtgggtgtctgatagaggttagtcggtgcgactcgttttacaaattgaaagacaagcagtgtgaagacgacttcgacccagccggcgactaataagtgagccgtcaacattgcgggtaccgtaatgttgaggccatatgggcagtagagcggcgcaccacttgccgtatgagccagtatgggttgtaagccgagctcgataccagcaactagcgccgccatattaatgcctaagtaagcaccaattgcgagccccaacttttcatggtgccatttttgacctaggcgatagcaggcgtagccgacaaacggcataatgaccgccatattcaacgcgttagcaccaaaggctaggataccgccatcaccgaataataaggcttgtagtagtaacgtcacggtcagcgcaagacacgccgcccatgggccaatcaagacagctaaaagggttccaccgacagcgtgagccgtggtcccacctggaatcggcaagttgaacatcataattaaaaaagccaaagaagcggcgatgccgagcattggcagggtttcatgatgttttttgatttgaactttaacttttaaaacggcgacggtccagacgggagccatcgcggtgaccaacgttccgcaagttgcgggacttaaataattatccggaatatgcacggatgagcacctcactaatttgcaatttgatctaagaggtaactaacatcttgaataataaatttgtgatttttgaccgtaatgacgccgtctgttcgtaattccttgagcatccggttgacgctgctccgggagctgataccacagaaaccggcaatgtcgtcattggtgaccacaaagtcaatcagaatcccttcgttaacttttcgtccgaacaaatcaacaagactatagataaaggcacaaatggccccttttttaccgttcatgaccatccgttgcagtcgaagaatgttttcggacaactttttacggtaataatttttaacgtagttttgcagttcaggcgtactgttgacgtacttccaaaaagcgacccggttgacctggtaaaaagtggcgtattcggactcaatacggacgttaaacggttggtccgtagaacgagaaacttcatcacgcagcagggagatcacgtcgggcttggcaatataagataaattatattcgcgaccgtcttgtaaaataatgctgtttttgatgatgccgtcctttaagacgtacgtatagtgttcggctaaaccatgataggtcaggtaagtatgccgcttttttttgattgtcggcacgtgatgggcttccaaataacttagtaaatattcaatatcagttaataccatcttagtttttcagttctttcgtgaataatttttaaggttgaggtcagtaaaaatagcgattctcaacagtaatcacgacgataacgctacttaagcatagcggttttcatgattgtgacaatcgcatttaaagtatacatttgttaactatttttgaaaacttaaaatgtaacggacaagttatccgtcttctagtataacaaaacgtgcatgtaaaaattagtttttagagaaagaggatggctaaaagtcatggttgcaattgatttaccatatgacaagcgcacaattacggctcaaattgatgatgaaaattacgccggtaagttagtgtcgcaagctgcaacatatcataacaaattatcagaacaggaaacggtcgagaagtcgctggataatccaatcggctccgataagctggaggaacttgctcgtgggaagcacaatattgtgattattagttccgatcacacgcgcccagttccttcacatattatcaccccgatcctattgcggcggttacggtcagtggcgcccgatgcacggattcggatcctcgtagctactggtttccatcggccatcaacccacgaagaattggtgaataagtatggtgaagacatcgtcaataacgaagaaatcgtgatgcatgtctcaaccgatgatagtagtatggtcaagattggccaattaccatctggcggtgattgcattattaataaggtcgctgctgaagcagatttgctaatctccgaaggctttatcgaatcacatttctttgctggtttttcaggtggtcggaagtccgttttacctgggattgcttcatacaagacgattatggcgaaccattccggcgaatttattaactcaccgaaggcccggaccggtaatttaatgcataatccgattcataaggatatggtgtacgctgctcggaccgctaaacttgcctttattatcaatgttgttttagacgaagataaaaaaatcattgggtcatttgccggtgacatggaagccgcccataaagtgggctgtgactttgtcaaagaactttctagtgtaccagccattgattgtgacattgcgatttcgacgaatggtggttatccgcttgatcaaaatatttatcaggccgttaaaggaatgaccgctgctgaagcaacaaacaaagaaggcggcacgattattatggttgccggtgctcgtgatggtcacggtggtgaagggttttatcacaacttagctgacgttgatgatcctaaggaattcctggaccaagcaatcaacacgccacggcttaaaactattcctgaccaatggacggcccaaatctttgctcgaatcttagttcatcatcacgtgatttttgtgtcagacctcgttgatcctgatttgattacgaatatgcatatggaactagccaagacgttagatgaagccatggaaaaggcctacgcacgcgagggtcaagccgctaaagtgacggttattcctgatggtttaggcgttattgtgaagtagtatggcaaccacagcagaaatattgcaacaagtggcggcagggcaattaagtccgacggtggctgcccaacagttagaagcaggcaaaacagcggcattaggttttgccaatgtcgatttagatcgtcaacgccgcaatggctttcctgaggtcatctacggtgctggtaagacggcaacccaaattgtgggtatcgtgcaagccttgtcccaacagacgttgccgattttaacgacccggttatccgcagaaaaattcgcggcactccaaccagcgttaccaacggctgtctatcatgccactgcgcagtgtatgacggtcggggaacaacccgcaccgaaaacaccagtgtacattgctgtggtgacggcggggacctccgatcaaccggttgctgaagaagcagcagtaaccgcggaaacttttggcaatcgtgttgaacgagtctatgacgtgggtgttgcgggaatccaccgactgtttgccaagttagatgtgattcgtggtgcccgggtggtcattgtgattgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataatggctttggtgccgcctactcagctagtatgatcaatcaaatgtaagattcagttaactgaacaaggagaagataaatgcaaacactttatttagacgctttttcggggattagtggtgatatgtttctgggcgcgttactcgatttaggacttgattttgagcaattaaaagccgaattggctaagttacacgtgcacggttatgaattaacgcagcaacgggaagcccagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatctttatggaaattgcgcaagcggaagcagcggttcatcacatgccactagctgaagttcatttccatgaagtgggcgcgttggattcgattgttgatattgtgggctgctgtattgggttggaattgatgcagattgataccatcatggcttcaccgttaagtgatggtagtggttttattaacgttgcccatggtcagatgccagttcccgtaccagccgtgatgcagatgcgagttggtagtgctattccgattcaacaacggttgggtgtgcatactgaattgattacccccactgggatgggcttggtcaagacgctcgtacgtgaattcggaccgttaccggaaaatgccgtgccaactagagttggttatgggtttggtaaacgggacacgggtggtttcaatgcactgcgagccgtattattcgaaaaaaaaaactaagtcagcaaatcgttaaccggacggctgatgctgtcttaatgattgaagctaatctggatgatcagacgggtgaaggactggggtacgtgatgaaccagttattaacggcgggcgcatacgatgtgtttttcacgcccattcagatgaagaaagatcggccggcgacaaagttaacggttttgggaaacgttaacgataaggacttactgactaagttgattttacaagaaacgacgacgattggtgtacgttaccagacgtggcaacgtactattatgcaacggcacttcctgacggtcgcaacgccgtacggtgacgttcaagttaaagtggcgacatatcaagatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggttttgggattagcgttgccttattcatttttggcaatgtttgcattaacccggcaatggttttggcgcagtgtctattaggaaatatcgcatggtctttatttattccgtattccgttgcggaagtgcttggtggggtcgtgggctcagtgatcgtttggatcatgtatgctgatcattttaaagcctcaacagatgagatttcacccattacaattcggaacttattctgtacggcaccagccgttcgtaacttaccgcggaatttctttgtggaattatttgatacatttatttttatttcgggtattttagcgatttctgagattaaaacgccgggaatcgtgccaattggcgttggcctacttgtatgggccattgggatgggacttggtggtccaactgggttcgcaatgaacttagctcgagatatggggccccggattgcccacgccatcttaccaattgccaataaagccgatagtgattggcaatacggtatcattgtgccaggaattgcgccctttgtcggggcagcaattgccgcttggtttatgcatggattttttggaattaattaaattaaatagaagaagggttttattatggcaacattagcaacaaaaaaagcaacgttagtagcattaaaggatttaaaacgggtcaccgtggccttttctggtgggatcgacagtaccttagttttgaagatggccctcgatgttttaggccgtgacaatgtgaccgctgtggttgcgaactctgaattatttacggatgaagaattcgataaagcgatgagtttagccgaagaactaggtgctaacgttcaaggaactacgctagactacttgagcgatgaccacatcaagaacaacacgcctgatagctggtactatgcgaagaagatgttctacagccggttgaatgacattgcggctaataatggtagtgcagctgtcttagacggtatgatcaagaatgatgaaaatgattatcgtcctggtttgaaggcccgtagtgaagcgggagctcggagcttgttacaagaagctgatttctttaagactgacgttcgggccttggcacaagaacttggtttgacgaactggaataaagtggcgtcatgctctgtatcttcacggttcccatacgggacgacgttgacacatgacaatattgctcaagtaatggccgccgaaaaatatttgcgtagtttaggttttccaacggtccgggttcgtttccacaatgatattgcgcggatcgaattaccagaagcgcgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccagttacaagttggtcacggtgcaagacctgagtaattagtgggtcgaccttgccagcttggaccaaagctaataaggcggcggtcatttgcccaagatcggcaacttgcgctgggttaccgctacggtgggcaccaccgaggtccaatttactgatagttaccacttgattacttggaaagtggtccggagttgctaatacacagacaagctggccattgtaagctaagcgcggtaagtccgcatcagcatgaccaatggtattaatgatcagatcaacaccgtgctgctgcgttaggtcttgaatgcgtgtggtcacatcttcatgatggtaatcgatttgggcatcgggatgcagcggtgccacgaaggcttgcttggcctttgaaacggtcgtgaagacggtcttgccagcagccttagcgagttgaatagccatactgcctacaccgcccgcacctgcatggatcagcacagtttgcgcggcatttaaattggctttgcgcaggagggcctgataagccgtcaatccagcgcagagactagcggcggctgcttcaaagctcacagtcgttggaatcttagctagcacggctgctggtaaactcacgtattcggcaaacgtcccattattggcgagattagcgtgcccacaaactcgttcgccaggccgaaaattagtgacctcagcgccaaccgcctccacgattccagctgtgtctagtcctagtgtgtgtggatattgccaggcggcgttacccgccgcaactaatttaaaatctaccggattgagcccgactccttgggtcttgatcaacacctcagttggcccgaggttgggcatgggccgttcttgccattgaagctgttccatagtttgagcggatggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagtaattgaatatttttaaacactaggggtgtccaaaaatgggctgagatggtgctgtaagtgccgatccctctgaacctgtaagctcaaacttgcgtaggaaagtgtcacagctaatgttagcggccactggatcaatgcatgttgattggtggtcgtttttgattggtgtgacggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcggagacgatggtccaaattgccggggcagtttgcattaatttaggaaccttgaccaccacccagattgatcaaatgcgagtggttggtaagcttgctaatcagtatcataagccagtcgttcttgatccggtggccgtcggggcggtcccttatcgaaaagaagtcgcgctagcattactatctgattttcaagtcgatgttattcggggcaatgctggtgaaattgcggcattggctggcatggattggcaagcgaagggcattgatgcggggagcggtcagggcgacctggttgaaattgctcaagcttgtgcacagcaatttcaatgctgtgtcatattgtcgggacctactgatgttattacggatggtcggcgcgttgttaaagtcgctaatggtaccccgcttttccaacgtcacgtgggctcgggcgatttactttctagtatcgtcgcggcttttacagccgttagtccaaccgatatttaccaggcggcgcaagtggcttgcttagtcttagcgggagcgggggaacttgtcgccagtcagctgacggccgatcgtcccgccacatttgccattgatttgattgaccggctgagcttagtgacagtgtcagaaattcaaacaattgctaaagttgattaaatataatgaagggtcgcgagatttaatgaatgaatttccacaagtggcaacgattgctggtacggatagtggtggcggtgccggtgtcatggccgatttaaaaacgatgcaggaacgtcacgtttttggtaccgcggtagtcgttgccgtgacagctcaaaatacattgggggtccaagattttatggcaatgccgacgaagctcattgacgaacaatttgcttcgttagcagctgacttagacattcgcgcttgtaaaacggggatgcttgcggatgctgaacatgtccatgccgtcgttgagaacttgaaacgatttgattttgggccgctgacagttgatccagtcatgattgcgaaaggcggggcggcgttattagccgcggatgcgattaaaacggttcgcgacgaactgctccctttagcgactgttgtgacaccgaatttaccggaagcggaacaattgaccggacagtctatcactagcaatcaagcgatggttaaagctgggcattcgctacaggggttaggtgctgacaatgtcattattaaaggtgggcatggtgataatcccgatttagctaatgacttcgtattgttggctgacgggaccgccttttggctttcggctccacggattgatacggtgcggacccacggcacgggagatactctatcggcatgtattaccgccgaattagcaaaaggacggtcaatggctgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctgaatgtggtcgtccaaacggccttggatgcaggcatcacggcatttcaataccgagataaaggcaatagccagttgactacggctaagcgttttgcattggggcagcagctgcgggaacgctgtgcgcaagcgcatgttccctttatcgtcgatgatgatgtcgagctggcactcgcactgcaagcagatgggattcacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacgggcttgcgacaattagtcgtgactgcaacctgtcccgttgtcgccattggcggaattactgtcgcgcaattgccagctattgcggctactggtgcggctggcgctgcggtgatctcaatgttaacgcgtagtcccgatatggctgccacggtcaaggcgatgctaacggctacggagggtcactgatgaaacatgacgggatttttcggagccaatttttactgtggctcggtgcggctatctcaattgccgaaatcttaacaggtacgctgatggcaccactggggctgacacgcggattggctgcgattgtattggggcacttgatcggctgtggcctgttcttggttccagccggctatttgggggctaaattacaccagtccgcgttagcgtcagcccaactggcttttggtcgcggcggggtgttactagcgtcaggactcaacgccttgcaactcgttggctggacggcggtgatgatcgtcaatgctcagttagccatgaacagtattagtggaaagctatttggctttcgaagtccgctattaatggcaaccatcgtggcgattttgattattgcgtggttgctcatgggtagtcagttactgttcaaaatcaacaatgccgttgtgggcttgttggtgctcgggacggtgttaatgctcgtaatggtatttatggcaccgacaactagtcagtcggtatcaacgactagtatgacgtttgggcaagcagtggaattgaacgttacgatggcactctcatggttgccactaattggtgattatacccagcgtgttgatcgtcctttaccagtcgcactagtcagcgcgggtggctatatgttaggcagtttagtgatgtttgtgacggggctattagttgtgttacggacagggcaaactgatatcacggcattgctgacgcggtccggtttaggattggttgcattgctgattattgttttctcaacggtgacgacgacatttttagatacttattcggccgccacgagtttggctaatctgaccggtagccgccatgttaatcgattagccgttggtgtgacggtagttgggctattgattgcgctgacggttgccatgacgtattatcagaacttcctgtatttgattggttcggtcttcacaccgctatatgctattatcttcgtcacgtactttgtgcggcacgctacgttaccatactggttgaacttttgctggtgggttgtggggattgtcgcctattatcagttacaggccattgatttcattggtggcacgacgctattagtattggttgggctgagcatcgccgtctggttgacgggaattatcgtcaaaccaaccgagctcgaatatcgcgagcttagtcattgacaattagatgtaaaaagtaaatgataatcccattggtaatacgcatgttaccgtgggatttttttgagagagggcgacagaatggttaaaccgataattggaatcgcaccaggcgttgtaacagtgaacagccagatgttcccggggcgggtccgtgattatgtgaatcgtgattatttgaaatcagtaacggataatggcggtgtgccattggtattaccggtaacgaccgacgcaacgacgattgaacgatacgttggaatgatcgatggtctactactttgtggtggtgcagatgtggccccattgacgtatggggaggaaccccagcctaaattgggtggggtagatccggaacgggatcagtatgaaattgcgctgattcgtgccacccacgccgttggtaaaccggtgctcggtatctgtcggggcttacaaatcttaaacgtgtgctatggtggcaatctttatcaggatatgagtgaactaccagctggtcagggtaccttaaaacatatgcaaggacaattggccgcttacggcatgcatcacgtgaaggtcgtacctggtacgaccttagctgaatatttaggcaccactagtgacgcaatcgcgatcaattcatttcatcatcaggccgtgaaacaggtggcaacgggctttcaggtggtggcccaaagtgcggatcaggttgttgaagcaattgaggcgacagctggtggtctacagttgggtgtccagtggcatccggaaatgatgcaacaggtaaactccatgcaggcgcggttatttgcggcgtttgtgcgggcttgtgtggcgtagatagcattgactagcaaattaataaaataggcgtggttattctgaattgtaggataaccacgtttttaatgtgcagccgcaaaactaatgaatgtttcacgtgaaacgtctgaaatggtgttggcaactagataactaatccaagatattgtaagctgacgtgtaaaacaattcgtaaagctgttaatactggcaacgctttcgtataatggaataaagttattgttaagggggtgaccgctatggaacgaattgaagctggcatgagcgtaatgacgttgaagaagcagacctatcgggttatcgctgtgattaatcaggggcaagaactgttagttcgcgcccacgaaccagaaacagctgacattgaaatgattccagtgaccacagttgttcaagtaactgaacaaaattcaacaggcgatgcagccgtcgcattggatacagtcacggtcgttggcgaacggtatgtcgatgatattgtggcaacgttaacgacgctcagagtgggtatggcggtgttgctccagcgagaaagtggcaatcaatacgatgataatgccatctcagtgtggacgttgcaacatgctaagttaggctacattgcccggtatcagaatcagccgtacgcggcactgatggatcagggacaacgattgtacggcatcgtgacggtattagatcaacaaaaacagcatcttgaattgatgctatggcggactactgcagtcccaagtccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccgctgatgaattacacgtcaccaaacgttatctattaacgcctgattggtcacaagtgccgccgaacagcctcattacttgtcaagtgacggcgaaggccgacgtggttcagcggtggcaaaatgaacacatttcagcagcggtcttaacgaacgctagtagcttttatgtggttggtatcagtgctcaaaccaagacggggctgaatgataacttggtcgatgatgctgcgcaacccgcggttatttaccgagttggccaggttagtgcacatatgcaggccggcttcatggtcagctgggcgccgtttggtgatccgcgcgtacaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcctagaaccaagtgtgacaacgataacggtagaaaaattgcggcagacgttaggtgatcagacgtatcatgcgctggcgaattatcagcgtcatgttcagctagttgcgggtagtacggaaggtgtcaacgagaccttgttacaggcgttgattcatgcagtcacgtatcatgagttgacgaccatgcactattaccagccgactgtagggatggtcgaccaggttatttatccgattcaattatttagcaccacgactaaggatgaggatgatgcacaattagtgggttgcttagcgctttacaattacgaaacgtttgaaatccaacaggtgccgctgacggcaattgctcgtatcgcgattattgccgatccggagcatccccagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaaactcagtgggatttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttttacaagaaagagtgcactgattgtttgagctacatcgccgttaggataggccgtctcgcctttatcaaagataccgatgcgatcaacaacttcgacatcaatgccactatcttccttatattcccgcacgcaggccgtggcatacgtctcaccgtattctagatagccaccgggtaaactccagttatgcgtatcggtacgaaggttcagcaagacttgttgctgatcgttgactaaaataccagcggccgtattcaaaatgattggtttgtgcccaaccaaagcccgaatttctttaatgtaatttgccatgacgaaacctcgtttctagtttaattacccttattataccgataattctgactgaaagctgtctgttgataaatttatacgaagcatgctcgaaccgcgttagagcaagtacatactgactatgtgtcactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgaaatgattgcactaggcggctactgccggtattggtggccgaacttgccagactggattccgggcctaattgccattgtattcttatgtgcggccaaccttatctcggttaaaatgtttgggacgctggaaacctggttctcacttattaaagtggtgacgattattctgatgattattgccggtttaggtctgattatttttggtgttggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggtgccatcttcgtaattgtcagcatttacccctgggataagttaagccagattggttcaccgtttgtacagacatttgccaaaattgggattaccggtgcggcttcgattatcaacttcgtggttattacggcttccttatcgggaacaaattctggaatttatagtgcgagtcgaatgacttacacgttggcggaaagtcaccagttaccaaggaagatgactttattaaatcgtcatggagtaccattttattccgttattgcgattgcgaccgggattctaattggagtcgtcttgaatgttgtattaccaatgtttttcaaggacgctagcgagattttcgtgatggtttacagttcgagtgtcttgcccggtatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctggtcatcatgacattgatttatttccgtaaatacgccggtaacaaggaagaaacgttgtaatcaagagtacttgccagtaaatggtaagtgcttttattttgggcttttattgcgttaaaattaggtatcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcggccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcacgctggacggcttttctgaacaaggaagtgccggctgtgccgttaaatgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaacagtattcaaacagcaacggggattgattgggaaaaggttgctcagttgcttgattcgacagtaattgcccagaatacactttccgaagctgggttggatgacaaaacgcgccaatggatagaaaaattacagaagctaaccccacaagattttaacagccatgttgaatgaacagtcaaaaaggaggatggtgaaatgcattttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacggcgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaaacgaaaagcacttttaacacctgtattaaaggtgatattacagtcttgaatagtagtcatatcaagcaggtttagaataaaataatgtattatgttgtcttgaataacggccacatcaaaaacagtttcacaatactaaaaaaggctcaccaacctgttttagttggtgagccttttcgatttattgactaattactaatcaatcacgccatcttttcccatccatcggaaccgaataaacttcccgacctcggtcacaatcaagacgacgatcccacagataatcgggatgccccaaccataccagaagttgatgctagtcgtatggaagacgaattgcatgaatggtaggtaaatgattcccagttgtaagagaatcagaataccaatgatgtagaacgccatcttattttggaagaagtacttggaaatgacggggtggtcattccgcaagttgaagaggtagaaaatcttaccaaagatgatgatgttcagtgacatggtactaccgacgacatttggtaatccaagtgcggtcaagtagttgtaggcgaagatccccaatccagaaattaggaaggagacatagccgatttcaaagtaatctaattttgacaacaacccagacttaacattccggggaccccgggccatgatgccggcctctggtggctcaaagatgaacgcaaactggatggtcagcgcggacaccatattgatccacagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcgttgaccccatcgccagtcatcgaaacgacgtgattattggcctgttgggcacgaacaatccgtaatttgttattcggtgttgcccgtgcgaagacgttataatcatcgatgtgtgcttgtaactgctgatcgtccatcgcgtcgatttcaggaccagtaatcgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcggcggttaagtcgtccatggcgtcatcccagtatgccgtttggttagcttggtcagttaaacgcaggacagtcgcgggtgagcccttgaccattagtaagcgttgaccatctaagtcggccaggcgagcagaaaaacggaaggcggaatcgaatggtagcgagtcaacttcttcaacctcaggatcatgaccagtcattttacgatacagcgtcgtcaaggcaccatcggttggttcaccggtcagttcccagcgattgttttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcgggtagtgacttgacaatgacgtttttcttcgtcatctgccgggttcccatggctaagaccaccgaggtactagcgggcagtccttctggcatagaaccaacgaccatcgtaataaccgcaattagtaaagttggcaaactataggtatccatgaccattcctaataggaataataggacggctgccaccacgatggcgatggataagccaacccccagtgagttcagattacgcatcagtggggtagtggtttgtttgacgtcgctaacagactgctggatatgaccgatttcggtatcttcggcggtagccgttacgattccgacggccgaaccgctagtcaccgcggttgacgcgtaaaccatattcttacggtcagccaaagctggcgtggtctcagtaatcggttcttcttgtttctccacgggattagtctcccctgtcagcacggattcttggacgttaaagttatccgctgaaatcaagcgcatatcggcaggaaccgcgtcaccggcttctaagttgactaagtcaccaacgactaattcgcgggcgtcaatttccagtttttttccatcacggatgacgaaattcttggaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattgaacgaaccgagacgtacgcttggtctccagttcgttgcgaccgttatgttgtaaacgttcggcagcttcagcagtgctcaatccattctcaggatcggtggcgtactttgcggctaaggctgattcatcaagctgccataagttatccgcatcgggagggttctgggtgtcgttttgctcttcattagaggttaacgactgattgtcatcttttatcattcaattcgctccttaaaaataaagttattaccggtgaggttctgtaaaatcacgacgtttattgcgtgttaaataggccaatttcgccacatcctttcttaattagcgttattataaataatattatatacgaacaatctaggtgaacgccattaaaatatttgacaaattcatgacaaattattgcgttagttgcaataatatatcagattttggctagtttgtcgctgaaaatgactggttttcctcgaattgttgggtaaattaaatagggagaacttaagatgacagataagttaacgttattgcaatatgatccaaatccaacggctatggtagggccagacgtggatggccgctttactgttccagctaagctactctacatattttctggtgatgattattttcaacaattcgtcactcggtatcatggtcaccgtttaggccaatttaataccattactaaagttagctgggtttatcaaatcggttatcgtggtcaaaaattggcagtagcgcaagcgccccttggttccccagctgcgacaatgtatttagagatgttgattgattttggtgctcgtaccgtcatagccgttggtagttgcggcgcattaacagcactaccagaggaacaattattaatcccaacggtggctttgcgtgatgaagggacgtcctttcattatttagcagcagctgattgggtgccactcgatccaaaggttatacaggtactcgggacaacattgacgaaggcttgcctgccatggcagatggtcaaaacgtggacaacggatgctttcttccgtgagactgtgtctaaagtcaaagctgctcgtcagcagggttgtcaagtcgtagaaatagaatgttcggccttagctgcctgttcggcgtttcggcaagtttcctttggacaattactatatacggcagacaccttagcacaactagagcactatgatccgcgacattggggtgcgggcggtgttcttgttgccattgaactagctacggaaagtttggccgcatattagcgaataaaaaacgagcagtcgatgactgttcgttaatagtggttaatccttgatggggtccttcattaataaccagagaatcaggtaagcgatgataccagggaacatgggtgtaattgctaaaacaacaaataatagccgggtaacgttagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaacggcgtagtggtaagaaccgtggtatagtaggtgatttcggtcaaagcttggtgaagtgcatgatcgtagcgtttgctcaggggcgcgttatcgataaagtgaccgttactttgaagggtttgtggtacgttaccaatgggcgttggtttagggaggacgaccattcctaatcgttggagaactggaactagtgcggccgccccaaattgaccgccgcgcatattgtcagaatatgagataatcttagccggtttacgggcgccttcgaatgccaaaaaatcgaaggcgtttttcaatccagctggcatcgcgtgattgtattcgggtgtcaggataatgtaactgtccgcactagccatatcggtgagccattgctgctggttagcaggtagctcgcggtgcgggttcgccatcggtggctcgggttcatcgaaaaggggaagctgatagttggccaaatctaaaaattggtagtgaatcgtagaatgagtcggtaattggtcaatgattaattttagatggttaaataaagcgcggccgttagcctgtgaccgggtactccctaagatgattgcaattttaaacatagtgggacctccagatatttttattgattctaatgaatacaaaatgatagtatagacttaataatattggtatgcaagtatttattcacttgaattaaaaaggagatatttaaatgacaacaccattagttagtcagttgatgacggaattaaatcaatttttgacgcaggatagcgttgatgatcaagaaaaacgctgggccatgcaacaaacgactgatccgcaattacaagcggcattaaaacaactatcgacgacggatattaaaattattgcgtatctgggacggcgtggcgccagtcgagctaagtcgctaccggcaccaacggaactttcacaggcgacgatttctcgcggtttgactaaattatcccgattgaaattggccacgaaatatcgggatttgaccaataacaaagaaattctcgtgcgattgacgacgctgggcgaagcagtcgctgatttacacacgcaactggacgcggccattgctgctaaagcacaagccattgctgatggctattctgacgcggaactgagacgctttgttagcctaatgcgacggattcgtgaaattaaaatttagcactccggttaaatgagtgctaaattgttgcattcccacaaaatggtgttagtatatatatcaaaggtcaggaaaggtcaaacaaggatttgaattactgaccagtattaatagccaagtgaaattttgaaaggggattgttagtatggctaatactttaatgaatcggaacgatttcggtatgttggatccgtttgaacggatggcacgctcattctgggcaccattagaaaacatggatcaagtattgaagaccgacattaacgaaactgatgatcagtatcaagtgaaggttgatgtccctggtattgataagcaagatgtgaagttggattatcgtgacaatgtgttgtctatcaaggttcaaaaagatagctttgtagatcatgaagatcaagaccaaaacattgtgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcattaaatcatcagtaacaagtgagcggcccaccgataatcaaatcggtgggccgtttttgacatcaacaatcggtatgaattatgaccggtggttggtaagctgttggtttagctggatgactttgatgcgggcgagtgccatttcaattaaccatagaccgatataggctccggtgtaaaccaaggtatagaagccaaaccagcgaatgtttaatggaaaacagccacagagaatcgcaagtggggtcatccctaggtaagaacacagacaatgagcaatggtttgtttcgtaatcgaccacgtttcaatttcgaatagccagctactgaatgcccaaacttcaccaatcagaatccacaataatgtcgaaagctgggtggcggctaagggcgaggaccagtggctgacaaaagtgggattagaaggaaataaataggtggtattaaagaaggttgagaaccccaaggccattaagtagccgataacgatgcctccgatggcgccaatcaaaagggtgtgccaaagtcttttcataattgtgccgcctttctaatttgttgggtatagcgtcgtgatgcgtatgttgttgtgccggttgttaggttgacttgaaagctaccccatttggttaaggtaaaatttttaacacaggcgattcgcacaatttcactactagaaatacgtagaaattggtggggtggcagttggtccattaaagtgtgtaagtggctgtgaacgaggtaagcaccggtggttgtttcacaataaagtcgtttattggcagtgtaaaaacgtgacaccgattgaagtggcagcttaatgagcgagcgatcttgaaaaacattgatgaattgctgattagtcaatgcttcaatattccgttgtagttctttgattgccggagttaactgtgggccgtgaatagtcacgaagacctgatgaatcgtttcagagatggttaactggacgtgcctcgttgattcccccttaaatagcgattttgataagcttattgtagtgaaaatgcggcttgacactagtgcttattgttacttggtcaactaaacgggctaactggtcaggaaatatggcaaaaaatttcccgggaaataattgtcactggtggtcgctaaatatgataagctaattaacggtataatacttactgaaaattagtgtcaattagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcgggttagcgtttgcagctgattacgcgatttcagcaatttcggcaccactgtggggcatcattgctgataaaaaaggtcgtaagatcatgctattgcgcgcgtctctagggatggcagttgcgatggggttaatgggctttgtaacgaatgtctggcaactagttgccttgcgcgcgttacaaggtgtgtttgcgggctttatttctaatgcccaagccttagtcgcgtcccaaacgccgcgtaaatatagtggacgggcgttgagcactttgatcactggtgccgttagtggtcaattgtttggcccagtgattgggggcttgctagcccaattgttttcgattcgaaacacgttttttattacggccggattattaatggtagcgttcttattgagcctgttctttgtacaagaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgttcgtgaattgatgcattaccgtggcccgattacggttgtggccggaattatcgcagctttaccaggtatttcaaacatcttttcagcaccgcgccttggacgttatggtgatcagcacggttctggtaaggtattgttatttggctatatttttgcggtgattatgtatttcccacaaggcattgttacgagcgtcgtggcccttggtattttgcggtttgccattgggatttccgatggcgcactgtatccagagattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggttagttcctgatatttggaagaacggcaaacgggcagtttcctaggtgtttggtagttagtctattaaattggctagctgcctttttgttacttgtccttgaacatgatgttaattcagtgtattgttagtttcatgaatatcgaaataagcaaacaagatcaggctgatcagcaacgagtggcgattttcaaagcactggccgatgctaaccgattacggattatccgggtgctctatcaagcacaacgggaaatgacttgcagcgaagtgggggcgcaattaaatatcagcaagtcaaccgtctcttatcactttaagaccttgcggttagtgggtctcaccaatacgcgacgaaaggcacagacgaagtatctatccttacaattagcgacctttgaccggtttttaccggggttcttagcaacgctttagtttttttgctttttagttcgacaattatcgaactaaaatcttggaaagaagatgtcaactacttatgaccacaacacatcaacatagccgctatttaacacttggaatgatgttagcggcaacgaatatgcgtttaccaattacaatgatgccgggattaatcagttctttgaaacggacactgggtttgccgagctcgatggcgggattactgaccacgattccattattgacgtttgccattatgtccccattgattgcacattgggggcggcgatttggcaacgaactgacaatttatgtcatgttgatctttctagccgttgggagttatctgcgggtcatcccaacgattgcggcccttttcattgggacgttactagtcgggattggcgcggacggtggcaatgtcttgattccagcgattattaaagataattttccgacgaagattccagtcgcaactagtcaatacacgctctcaatgctattagtcggttcactgggaacgggactttcgggagtgttggcggcacactggtcgttaccactaacgatggcggtgctatcggtgattggactaattaatttggttgtctggttgccaaacttgaaatacaatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccacggcttctccttgattgtggctggcaatttagttacggtcatgcaattgagcggcctaccgatgtcatatttagtgccagcgacttctggtcatcggcgtggcgtttgggcaatgattatggtggtaggtgtcggttttattgcgggaattggtggtatcttactttccggaacgaatttttgggtggcagcactatcctgcgtcttgctaggattaggatctggagcagccttcagtttggcagtcgtcttctttacgcaaaaaacgaccaatgggtttgaaacggctgacttatctggtatggcccaatccgcgggctatttgctagctgcagtggggcccgtactattcggctggttaggcggtcaattaggctggggaccagtactctggttagctatcattctttccgcgttactagcattatccggcagcatcattttccagcatgcaacgatttatgagtaattaatatcacaataatgcagaacgagattggcccaagtcaatttcgttctttttttgaaactttatctttgccttagagttactctaagggactacactaatctctattcaattaaggaggccacagtaatatggcggttattcaaattctaacggtcgtcggcgtggcgatcatcggggcaagccttgtaggtgatcccactcagcaacgacagtcaaaaccagtaaaggagcaaaaataagatgacagtgttaacaacgatgtatcaactagcaaatggtgtcaacattcccaaagtcgcattcggaacttggcagatacctggtggtgaggcaacgtatcaagccgttcgtgcggccttagcagcgggataccggcatattgatactgcactggcctatcaaaatgaagcaagcgttggccaggcgattcgtgattctggcattccgcgtaagcaaatctttgtgacgactaaattaccggccgaaacgaagtcatatcaaggtgcactgaatgatttcaatcgttcgctgaaaaatttgggcttagattacgtggatctctatttggtgcacgcaccttggccatgggggcaagccggtcgagtttacgatgaagctaacctcgatgtttggcaggcaatggaagccatttatcaaagtgaccgggcgaaagcgattggtgtctctaactttgctgttcgggatttgaagaatattcttaaccaggcgacggtaccaccaatggtcaatcaaattcaatattacttgggcttcacggaacctaagattaccaagttttctgaggaacatgccatgcttgtagaagcatactcgccgttagcgacgggcggggtcctcgataatccgcaagtacaggcctatgctgataaatacggcgtcagtgtggcgcagttagcgctacgcttcattttgcaaaatggggtcttgccattgcccaaggctgttaatccggtccatattgaggcgaatacgcaattggacttcacaattagcgcggccgatatgcaagccttaaacgacttaccagatgcggctggttcttacatgcacaacccgacccaaggttaacgaacaaaatgtttgaccgcacttgggttgataggagtaaactgaacataattaatgaacgataaggagcgatttgatgacaacgattaatgcagctaacgcgggtacttacgcgtttgatgatcaattcaaagttaaccggatgggttatggcgtcatgcagttaacgggtcctgggacatggggaccatacgctgatcctgaaaatggggtcaaggtagttaagaaagcactggaatatggcgttaatttctttgatacggctgattcatacggtccatggtttgctgaccggtacttagcggcgggcttgaaggatgccgctaatcgtgatcagatcttcatttctgataaggtcggtcaaacgcggcaaggaccgaatgtgtggacgccacttggtgagccacggtatctgcgtcagcaagtagaagtttcaatgatgacactggggattgaccatgaagacctagtattcttacatcgaattgaccctcattactcgattgcggatcaagtcggtgaactcaaaaagcttcaggatgaaggtaaaatcaagcatatcggtctgagtcaagtaactgttgatcaaatcaaggaagcgcagcaagtcgctaagattgatgccattgaaaatctctataatgtcgccaatcacggtgatgatgacgttgttgactacgcggcctcacaaaagatggcttttctgccatggttcccattagcaacgggtgaactggctcaggctgggagtgtcctcagcacgatggcccaaaagtatcaggtgagcccagcgcaaattgccttggcttggctattgaagcggtctgataatatcataccgattccaggaacaagttctattgagcatttacgggacaatgtggcagccgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatttgggaaactggaacagcatatggtttagatatccccgttgcttactatggtgaaacgttagctgatggcacgtttaatgtgatgctggctaagtccggcaaagcggttattgagaacatgactgatttgaaggcttttctacaagatcccactgccgatgattttcaatatacaggaactattcgttaatttgaacggttagtcaaaataaaaagcgagccgtctgcatttgtcaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactagcgcaaatattaagaaagcggcaagaaaacaaaaaagttcagttcaaactagacaatcactatccaagttgtataatgtacttgtaagcgttatcagaacctaattacctattttgggggcgttatttatggttaaaagtaaagcaattatgattggtgccgggctatcaaatatggctgcggcggtctacttgattcaagatggtcattgggatggtaaggacatcacattctatggtgttgatatgcacggtgcgaatgatggtggtgccacgactgattttaccaatgagtattggaataagaatcatccgatggctaacacgactgggtatgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgattatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagacgaaattacggtgactggcttagtcattgaggatgcgcagactggcgaaacggaagaagttgaagttgatgaggacacagcggtgatcttcactaacggttcaattaccgattctgcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttgttcttaaatgaaatcgttcggatcaccacccaggaacccgggaatgcgttgaactccttcttatcaactacgccaattacgccgttgaaccaaaaggatgttaatatgtctatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggcaatattaaggacaaggaaaaggaaattttggacagtattgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatgctgatgatggcatgatgtaaaaacgctccccatgaaagatgactttcatagggagcgttttagtgtgcatcacgatcagtagtaacggctcgttgagacgccgtcattaacaggatcaggttgctaagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagtgattttcctaaatgggaaaccgtctattattactggttactttggactaaaacgccatctcctgctggtatcactcatctggataaggttttaaaaaaattgtcagccaacatcggttggctcagaagcgttcagtttatacatcgttcatcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaacttcgctcaatcagttcaggcaatgattaacgctgaagtcattattgctaaacagagtgaccttaggcacggtcaagtgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttctaagcaatttagtggttgatcaaattttagcagctgctttaggtgttaatttagacggtgtgtgtttagtagtggttttgaccgtgagatgctttttggttgcaagtttgggcgcctttttagcgttttgcttggcggtctttttgattaattttggtgccattttcttagttttcgttggttgggctaacgtttttttagtggcgagagtcgttacctttttagttggtttgatacttgccttagggtgcttgatcgttagcttcgttgattttactttggtggtcgtctgctttgccaatttgattacctttttagaggctttgattttaggcgttgctttcttagtactagtggctttaggtccagcctgcttggtggtcttcttagcaatcgtcaacttagtcctcggggttttcttggtcgcttttaatttagcggtcggggcgttccctttaatcatcgtggtggctttagcccagccgagggccttaccgtgttcactaatgagataatatgtggccgacgtatgcttgccggttgctaaagtaatcgtcttagttaccgtgtaagtctttttagtgttgagttttgctttggccgggctaacaaaggcgattgcccgatcggcggcaaagtgaattgtattcaaagtcgtggcggccttcgcgtgcattgtgatggcgggaaagtgggtcgctttagtaagtgcatgggtagtggcttttggggttaccgtggcggcattagccgtggtagtcatggcaaacgggctggcagccaatggtaatgccaaagcaagtgttgcaacgactgatgttaattttttcatttcaaaatcccccttaaagtgaatcttttttgattcgaagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgaccgagattttagaactaacgttcgcactgaatgggaaagttatggtatgctagaacggtatttttactgaaaggggtgggcggcattgcccgcagcaacaactttaataacccccgctgaaaatcgtttctttctgttaagtgaacgagctcgacggcggaccacgctccaacaaattagtgcgttattacgcgcacacgtaacggtaaaggctgacagtgatttcttgaaaccgactattcgtaacttgattttacaagatcatgcacagtggttgaccgactgtagtcatgagtggcaacttttggcgagtctgccgtacgttgttaacccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacgcgttacttgatggtgattacaacagaagataacttttatgcggtggcccagtatcagacgctgactagcgctgtaccaacagtgccaacgatcatgtttgctcagccgtggctaccacaattaccggctgagcaagcgccccaagcgcgcaagttgcgacaaacaacgacgcaaaccgtcacgacgtacctaaaacgtcgtaccaagcagctaccattacaggaactaaagcccgctgaacaaacctatcagcggttagtccatgatgaacaaacggtgattgaagcggctgagcgggcggcccgtcaagcaattgtgactaatcaacaacaacgccaggcacaagcgcagcaaagtgctgtgaaggccgagcaaaccttgcgccagagtcacgcctatcaatgttatttacagcagctggcggccattattgtgatgcgtccggaacgaccgatggcgaagcaacagtttgaaaaaatcacgccaccagcgaccgaacgccctttggtgaactcttatcaattcgggcaaatggtgactgaatatcgacagactgggaagattcaagttcggcgcctagccatgcttgatcatcagttcgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacaatgccacaaactcaacagtggcttgcggacaatgcggatgccggtatgcaagcagcactacagcaacgtttggctgcgcatgaagaccgccaaccgattgcccgtgaccggatgactagatcggaattacgacagttttgtttgcgtgaacagccagctgcgccgacattagaagcatttgaacaggtctttgaccaacagtatcaattgcccgtcgaccggcaagcaacggcccatgaaacgttagcctattactatattgcgcgtcaatatcaaggtgaccatcagcgtgcgttacaacaactgaattggttattgaaagtctaaatgtttcacgtgaaacataaaaacgcccactgattttttcagtggacgtttttaattcggctgacaggttaactattaatgacgctgtgatagcgcgaggctgcaaattcatacagcggccggctaagtggtgtgacctcaacggcttcttcaaatggtgccgtaaccatggtgttgtcagcgtttttagcgagtttgacggcccaagttggatcataaagtaattgttggcccactgcgactagttcggcagtttgtaacacagtcttgacatcgtcgcgggtccggacgccaccaacaccaactagtggcaatttaccttataacgcttcgtgcacgtaggtcatgatggatttatcttgatactgcgggtctcgtgaaacacggtcatagttgttgagtgagacatgaacgtaatctaatcgactttcccgtagttgtgagagtaaccaaagggtatcttcaagccgaatacctggttcttcgaattcttctggtgagaaacgatagccaactatgaagggccggtccgcatattggtcaacagctgcaaagacggcctttaataattcatcaataaagcggaaccgttcttgcggcgtgcgaccaccgtattcatcggtgcggcgattactatgtggtgagaagaactgttggatcaaataggtattggcaccgtgtaattcaatcccatcaaagcgggcttgaatcgcgcgccgagttgcttcaccgaatgctgaaattgttgcgtggatctcgtcaatcgacattgctcgcggtgtttccgcatcgtcacgaagggccgcaacggcactggcagagacaatctgttcgccatttaagacggctcgatgcgtcattcgaccggcgtggaagatttgaacgatagctttggcaccttgactttgaatgccatgagcaagtgcacttagaccgggcagcatcgtgtcatgcgcgatactaagctcgccatgccaacccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatcttggcataacaggatggtgcgtgtggaataaggggattgttgctgttgttaagtcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcagagcaactaacgttaacgccagatagtcgttacgtttaaagcgttgggccatgtaccatgtgcgatgttttcccttaccgaagcgccgcaattccatcgcccgactaatggtttcgattcgatctaagcttgaaaaaatcaatggaagcagaatttggatgccgccacgaatacgggtcataaaatgcgcttttttcgacatttcaaacccccgagcctgttgtgccagactgatagtacggtaatcagcttgaacgtctggaatgtaacgtagtgcaatcgctacggaatagctgatacgataagaaattccaatcttattgagactcgcagcaaattcgctgggattagtcgtcatgagaaaaatcagggcgagtggcacggcaaacgtgtactttaataacaaattaaattcataaaaaagttgttcggctgtcaagttaaagtagtgatcagcagatcccagtagtaagtgttcggtaccataaatcgagacgccgtaatgaggcgcaaagacgtacaccatcactaagtttaaaacggaaaaaccaataataacgttaagcacgaacgcgatatcgcggtaatgaatttttgaaaagcggaatagaatcagtgaaaaaatcatcaccccgattaagtaacgcgtgtcgtaagtcatcatcccgataactgataagccaacaaagcagagtagtttagtgctaccgctaagtcggtttaaaaaagtatgacggtcgttgtacccgatcaataattcatgttgcatcttagcgcgcctcccgttcagcctgaacaaattttgcgacgaattctgtcgggtttaaatggtgcgcttctgccagggtgtataaacttgtcttggctaaggaagcttgctgaataatggatgcgttggtcaacacatcggctgggcgagcatccatcaaaatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgttgcaagtcttggcccgcagtaggctcatcaagaattagcatggccggttctaatacgaggatggccgcaatcgtgacccgtttcttttgaccgaaactgagcgcagaaataggccagtggcgaaactcatagagaccacagaccttcagaacggcctggacacggcgctttacttcatcgtcagcgacacctcggaggaccaaaccggcagcaacttcatcaaaaatcatcgttttagagatcatttgattggggtcctgaaggatataaccaatttggtcggcacgttctttgactgattggtcagctagggaatgaccgttaaatcgcattttgccggactgtggcatcaaaaacccagtaatcagattgcttaatgttgacttaccagtcccgttttgacccactagactaatcatttcaccctgatgaagtgtgacggtgatatcgttgatgattggtttggcgggatcgtacccgaatgtcagatgctcaattgcgagtaacggttggtcatgaacggtgggcgactgtagttgtacgccggcggtccagttttgcaacgtcgcggtgaggtcgggtacttgtaaggcttggaggttatccaagtgttggcaagttgctagatcaacaccggctagtttgagcgctgaaaggtataatggttcgcgtagcccgagttgagtcatgagtgattgccgcaaaatcgtttccggccggtcgttagcgacgatcgcgccgtcttgcatgacaatcagccggtcgattggttgctgtaacacgtcctcgatgcggtgctcaataatgatgacggtcaggtcctgcgtatgagtcagctgatcaatgagtgccatcgaggctttacccgatgccggatcaagactcgctagcggttcatcaaataataggattttactattgtcgatcagaacaccagccatggcgacccgttgcttttgcccaccagataattcctgcgggcggtgagtcaataagtcctggaggtttaaagtttgggcccactgttcagttgcttgtcgcatggccggttgggtctgctgatcattttccaatgagaaagccatatcttcgacgacagtcaaaccgacgaactgactatcaggatcttgcagtaccgtaccgacgtcttgggataatgcaaaaatggagctctcagtaatggtttgaccagcaatccttgcttggcccgtcactgttcctggataggactgcggaatcaagccgttcaaacaccggcctaatgtagatttaccggagccagaaggtccagcaatcaacactttttcaccggggtaaatatccagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaggtccaccaaggcgaaccataagttacgaagtcgtttaaggcgtgaccgatgaacacggctaaaccagctgcaacgggaccaaagatggctcctagtaaggctaaaaaccccatcgcgacgttaacctgggtattcggcacacccgttggaatggcgacaaatttcatgagaacaaaaataacggcggcgccgatcccggtagccacgacggtacgaattgaattggattgcttgttttgcatagtgtaacactccttaagtattgagaatgaataagttctaataaccattaataaaagcgaacaggcgttaatttcagatcagttatggtcataaaaaaacgcgcctaaaagcgaatgctttctaggacgcgtttgcgtgttaccaccgagattttcccacagggacttatcatgatcgtaacggatcgctccgactgagatggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacgggaaaatcgggaacagctgattaaatggtggtcaaatgcgctgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacataaaatccggtaaatatacgccgggcgaattgatgcccgaccagaataaattagctgaaacttttgatacgacacgaattacgattcacaaggccattcaattactgattattgaagggatggtttactccaagcgtggcgcggggacctttgttcgcaaggactttggtttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacaccgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaaagcaatcggtaaccgcgttaatcagtggctaccgattttttgtggaaattattctggggagttgcattcaagaaaacggtggcccataattaaattgattgaaaaagaaagcgcttcaataatctgattaagggggatgaaaatatgccagctaacttttatcaacgattaattgataagtatgaaccaatgacggaagcagcgttcttagtgttagtcagtgttcgccagccgattaccagtgaagcgattccggcaaagatcgctgaaatgaccaataatcaactacagctaggattgggaaccttatttacgaatttgcatgccatgactaaggattatttaatgacggaacgagtcgatgaaaatggcgtgcatacctatgaaatcacggggagtggtgaatcggttttggcggctgaacgaaaacgactgcaattattgaatcagatttgtgagcaggcgggattgtaatgggttaatttaacggggaagtgagtatatgtggcgttatcaaatggcagtcaaaggctcagagcaggaattgcgatggctcaattagcaggtacaacgcgggcaattactgcggcgtatcagggggaactggtatcaatttcaaaaaacgacgacgcggtatcaagtctttagtgaatatgtgagcggtaatgttgcaactgaaatcgacgaccagcacacaccgttcaaattgttagcacggctacaattgacgaaaccagccgtacaggtgatttatacgggcacggctcagactgagttgcagggggcacgagtggatcgtcaggacgcaccgttgcagttgaaaattgcactggcgcaacggggacacttgttaaatgtcatgaatattaggttagtgtttggtctgatactggccgtgatcgtgattagcctgaatgtgagtgataacgtggccagttggggaatgctagcatggttgctatttaccttctatcctgcatggcaagcaagtcggctgcataaacaggcgaatgcgctgcgagtcattacgcaacaatatgatgatgcttggcggccaacgatgcacgttttcttgaaaaacatgtccactgagctggatacagaaaaagtggcaggtctaggggcgtgggcttacgtcggtcaagatcatcacgggatgtactggtatgacttgaagacgctggcaagtgctgcggaaatcaagcaatcgctacagctaattgtggaagatagcgtttctgtatcgattgtaagttggctgggattggcaccaattggatttgtttaaacttttaaaatggaagtggtaggtatgtggcggcatcgatttttgatcaaaggttctgaacaggagttggcatggctgaatgcgcaagcgcagcgacgctatttattgatggctattcatggaaattggtatcagtttaaaaaagtgccgacgatttatcgggtctttagtgagtatgtgccgcaagcaatcgcggctgacatgagcaacagtaacagcgcgtttcaagttctcgcccaagtgcaagtacagcaaccagatgttcagattgtgtataccggcagcgaccaaccagcattacagcaaacgacaatggcaccaactgatcctaagattcgtttgcaagtagctttgcagttacgtgatcgggcgatgaatacgatcaatctcagtctttatgcaggggttgtggtatgcggattgtttttgattctgatccttcatcggggtgatacagatttaataggcgtctggatgctaatgctgttagtaggacttctcgcggtattaggactgtatcggacggcgcatcgtttgcagaatcaaatcagccagttacggcgtgacactgaacagtacgacggggcctggatgccgacgatgcacgtttttgtgagtgcattgactgctgatcttgacaccgagaaaccggcattaaagtcgttaggtcggtggaccttagttggtcatagtaaaaagggccagtattggtatgatctgcaaacgctagccaatgcgacagaaattaagcagactttacgaccatttgttgcgactgacactaacgttaacgttctgagctggttagggctcgcgccactgggctggtttgtgtgattggcaataattgtttgtacaattaacatataaaacgttagactattctgagactaacgtttttttgtgtttaccggtctgatgataatataaatgataaaaagtgacatataatcataatagtagtattctaaataaaagacaaagctggaataggttgagtgttagttaatcagctggaaattaatggatattgcgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgtggctgtttacgggcagatgttagtcgaaagaatatttttgaaaatccgcaaacccgtaaaaatatgggacgtagtgataacttaccgctttatcaaggaacttcggtcgatcgattgaaaccgaatagccggaatcggagcggggtcattggtgtttcctttgaccgatgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagatgcgtacataattagcatgccaggagactggtgtgctttttttgcgattattacccgggaaataaacgagttagattaatacccgtgaggaccgattatttgtgtttattgatcaaactagttagacttaacgagcaatttaaattagaacggaggaactttgagcatggaaatgggattagcagggaaacgggtcttggtcactggttcgactaagggaatcggacgggcaattgcggtagcatttgccaaggaaggcgcggatgtggtcattaatggtcgccgcacagatacggtggcagcggttgtggatgaactcgcagcggcatacccaacaactcatccagtggcggcaccgtatgatattagtgatccgcagcaagctgacaaaatgtttcaacaaattccaacggttgacgtattggtcaacaatatgggaatctttgggccaatggcttacgatgagattgacgatgcaacttgggaacgcttctttaaagtgaacgtgttgtctggcaatcggttggcaaaacattatttacctgcaatgttagcccaagattttggacgcattatctttattgcgagtgaagaagcagttatgccttcgggggaaatgccccaatattcgatgactaaatcgatgaacctttctttagcgaagagtctgtcgaagttaacagttggtagccacgtaacggttaacacggttatgcccggctcgacattaacagaaggtgttcagaaaatgttagatgatatgtatgctgattcagatttgccaaaggatcagtgggagcatgactttatgattaatcatcgaccactatcacaaattcagcgtttgattcggccggaagaaattggtcggttagcagtgtttgtcgctagtccgtttgctagcagtttttctggtgaagcattgcgggcggatggtgggttagtcccaactatcttctagtggctaatgaagacgatatatctttctggttctgccatagaaattcagatgtcaaaaaactgttttagcgagtaaagtttatcgccaaaacagtttttttgttgacttgactagcctcagaagccagtttcaagcggattagatgtttaaaatgaaatttttaactgattgactggctagtcattgacttactagtcaacggcgcctatgattgcagcatcaacaataagatgctcgaatttgaaggatgggagtgagtcatatggataaagaaccgttattaaggattagtcacttgcaaaagcatttcgggaagtttcaggctctcaaggatattaattttgaaatcaacgcgggggaagtttttggatttatcggtccgaatggtgctggtaaatcaactactattcgggtactacttggaattttaaaagctagtggtgggcaggcgacgatttttggtcgcgatgtctggcaggatagtgtggcgattcataagcgaattgcttatgtgccaggcgatgtttatttatggcctaatctaagtggtggggaaattattgacttgtttcttaaactaaacggtggtcagcatacggctaagacggacgcgctaattaaacaattcgaactggatccgcgtaaaaaagcgcgcacttattctaaaggtaatcggcaaaaggtggccttgattgcggcactctcaacggatgctgatctatatatttttgacgaaccaacgtccggactggatccgctaaatgagcagacgtttcaaaatgaagtattggctttaaaacggcgagagaagagcgtcctgttatctagccatattctgtcagaagtggaaaaaatgtgtgatcgcatcggtattatccgtgagggacagattgttgaaacggggtcgttagctgagatgcggcacttgacccgaaccacggtcgatgtgcaaacacgactgcctttgactgacttgaccaccctagctggtgttcacggggtcacagcgcgccacggagataaccacgtcagtctagccgtcgatgctgaccagttgacgccggtagtgcagtacttggcgagtcggaaactgatcagcttaacaacgaccccaccaacgttagaagatttattcatgcgctattacacgaccgaacaacaaccggtgaaggggaagtgatgctgatggcaacacaactatttgctcgtaccggattactgatacggttcaacttacgacgagattggaaaaagttgctcatttgggtcgtcgtgttgacggggctattcacggccatcgccgcgaagtttgatggtatttatggcactcagatggcactgaatgaaattgtcaaaacgcttaaaacgcccgcgatgatttccttatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttaattggtctgggcttagggggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggtctgtatgtattactgggtcttggttgtttaagtttggctgcagctcttaatgcttatcgggacttgggcgcgggcttagtcgaaccacggcgcggtcggcaacaggctagcggtttgttgcggggtcccgtgaccctattatggcggcaggcacatggtctgattattgcatggctactagggaactttatcttaggtgccgcgtatgcgtccgtctttaatacgattggcgatctggcaaagagcaatccaatgatcaaacaactgctaggtgcgtcagctttagcagcagcgaatcgcttgatcgtcaaaaatttcattgctgtgttggctatcgtcatggtgatcgttgcactggttccagcagtacagttaatgctcaaactggtcaatgatgaacaaaaaggctatctacatcaagtttatgcgacggccacatcacggtggcacgtgtgggcaagctataccggctgggcaatcgtaacgggattgctcgttttacttgccggtctaagtggtatgtatttgatgggcctgacgagtatggtcaagcccatcagttgggtgacctattggcacgtgtttgcggcctatgcaccggcgatgttagtgatggtagcggtgacgagtgccttagcgggctggcgacctaaatggcggtatgctgcgtggatctgggtattttacgccttcttctcattgtatcttggtaatttgattgatttgccaaaatgggcacgccgtttaacgccccttggctttgttaacaaggtaccaatcaagcccttagatggaacgacaagtagctggtgcctgttattaactgtgctaatattagtagtagcagcactaagttatcggcggcgtgatctagctcagtaaacgaaaggagtgcgtgacatggcagtaaaacaacctgttcctaaagacccggcgaaggtcgagcgtattatgcacgcggccatgcacgcctttgccgtcagtggctatcgagatgctaaaacggatgtgattgcgtccgcggcaatggtgtctaagggcctattatttcattattacggtagcaaacagcgcttgtatttggccactgttcagcttgctactgacacgattattgccaccattaatcaacaagtttttgatgttccagatgacctagtcacgttgatggtgcgaagtgcgcgttacaaggcggcgtttggtaaagaccacccggatgaaatgaaggtcttgattgacgcgtatggcgcgctggagcgcttgccggtaaagatacaggcacaaatgaagatcctgtatactaagtcgatgactatttcccgggaaatgatcagtcaggtgctggataaaatgacgctgcgtgcggatgttgatcgtgatgcaacgattgctttgattatgggtgtttacaatcagatttttatggaatttcagacctatatgcgtgagaatcatcaagttgaatcgatggccgatatcgaatgggtggtcagtcgcgcaaaaacctacatggggattttagaacatgggtttatggcggcggatttagatgaccagcagtaataatacgtgtcttagacagtcgacggatgtttaatccggacgactgtttttcgaccggtggattcggcagcgtttaatagtgataatgtttattcgcttttttcgttagcaggctaaaaatgtggtaagttagacttaatagatgacggatgaagtgagggatcggaatggaattacatttaacggcacgacagacgggattgtggcaacggttgatggcactggcacgtgagcaattgatgggactcgccatgcagatggagtcgactgggaaagtcgatcgaccgacactgacaacgcttgcccagcaattggctttggacgatccactaccagatgaccgcctgagccaacgggttttgagtacattagcgctggcgcaaagttcagctgggctcgctatgagttttgccagtagttggcaagttgaggatgcaatattaacgtttggaaccccgcaacaacgccaacggtattgtgcacaatcaggtgtttttggactcgcggcattgccggaacaagtcatggctagtagtaccgtcaaagcaatgccggtaacagctggctggcaactgtccggtacggttaaagcggtattgaatgttacacaggcaactgagtatttagttctcgcacagacaccaccgaatgctacgggggcctttgttattagtgctgatcagccaggcgtcacggtcagccaaccaataacccctttagggctacacggactgaccatcgcggatgttcaactcaccgatgtcccggttacggccgctgatcaaatcggtcaattgggacaaggacaacgagtgatgcaacgggcgcaaagcttggggcaattatttgccggggcgattacagcgggaatatggcaacatgccacagaccaggcacgacagttagcgctgacagaacagccgccgttaactgccttggcgccagcaatggcgattacggccgccttacagactagtgtctacaatgcggcccaacaggccgatgatgagcgcccatttacagacgcagcgcaattggcggcaatgtttgccagccaaaatgccttggcgccgtttaaaattttgatgccattgatcggtgatctagcctatacgcaacactcgccgttaagtgccttgcaaaatgacgtggcgacactaccgttgattgttggcacggatacgcaattggcgttgacttttgccacgacgagcctgaatgacgaagtggccgatgtcccgacaacgggaccccacacagctcctgagcacctagtcgtggccgacctacatcgggtcgtaaaacgcttgaatttgactagggatgtgccagtcaatgtcggcagtattgctacggcgaaacgcgtcgtggcattaggccgaggcgcgatggaaccggcagtattgcttcaagcccaacaattggccaagtggattggtgcagcattggctgttacccagccgctaacggctatggaacaatttagcattgagcaacaaattggtgcctcagcagtgacggttgcgccagaagtcttgatcaacattggcgtcgctggtgatgatgattacttggctggcatggctggtgcgcaacacgttctttctgtgaatacggatgaacaagcgccaattttcaagcattcacaacaaattttcgtgggcggtgccgctgaatttttggccggaatggtggcagcattaaattaatacgaagtcgagttcggcactgttggtaggtctgactgggtcgtatgacaatcaattgtttgcacaaaaactaagggtcacagcaatgtactgtggcccttggttttttacttagctttaaattaagtaccaccagtcattacttaattaacgaaataattaatgaccaccgtcacttaaagcgtgcggtgagctggttcagaatcggaatcttaaatagggcgatcaagataactgagtagcagacgtaggttatgacttcttgtatcatgcgcgttgttagcaaaactgaccatggtgttaagtacatgagatgaagccagaggctgtttaaaaacaaattgagaataaagacgacgataaagttagcgacgagaacgcgcgtcagtgaagtttgatgttgaaaggcgtatccaaagactaacccagtcagaaaagcggttaggataaaaccaggaaaaaaggtgaactttgggaagagcagcattccgagtagggaggaaatcgcgctactgccggctgtaactagtggtgaaaataaacgggccgttaaaccaataataataaacgcgaaggatatcttggttagcaatagttgaattgacagtaaactcactaagataagttgcatggcaattaaagcaccgagtaacgggatacgccgaaccgtgagtgatgatgtcataataattgaagccccctaagtgtgttgaatgtattttaggggaatttgttgagaattactagacctgaaattattggttataagtaatataaaaatatcactaggagaaacgctatgacgttatgtagcgttttctgtggtagcaaatcatctacgtcgtatattcaatgttgtgagtatgaaagctgctctatggttagcgctattttcttaagcttaagcgaagatctcaatgaagatattatctcgataaactgcgcataatattgttattataacggacggagctggtttgagactgcaaatacaatcattttggtatgatgtgtttttttagtttaaatattaattattatattgatttattagtaaactatcgatttcagaagaaaatcaaaggtaaaaaaatgagctcaagagagagtaagcgcttaatttaagtgctaaaatatctaaattaggggaagattgagtaaaaattcttttggaggttggtaccatggaagctaaaggaaatgttattctgcaagatgcagttagattcactattttaactacatgtttagttcgaattgagtattcgaaggatggaaactttgaggatagaaatacacagatggttcaaaatcggcatttcactcaacctccatttgaaatattcgaaaacaggcagggacacgtactcgaaattagaacaacaggttttcacttgtattatgatggtggtgcgttgagttcaggaagtttgtatattgatgcggctaatagctatggaacgcattatagccgatggtactatggtgagccaactaaaaacaatcttaaaggtacagcacgaaccttagatagggcggatggggcgatcccgttaccagatggattaatgtctaaggatggattcagtgttttggatgattcgcaatcgtttattctggagaatggtgagttctctgtgagacagtcaaaagagacagacttgtattatttttcctatggtcgagactaccgcaaaacattacaagtgtattatcaattaacaggtttcccgccaatggtgccaaggtatgcacttggtaattggtggagccgattttacccatatacgcagtcagagtatctagcacttatgaaagagtttgatcggtgtcaaataccaattgctgtttcggtatttgatatgaattggcatacgactgcaataccctccaaatatggtagtggttggacagggtacacatggaacaaggagtattttccgaacccccaaaaaatgtttgatctgttacaccaacagggacgaaaagtaacacttaatattcatcccgcatctggaatacgcccaagtgaaagttgttatggggctgttgcaaagatgctagatttagatgctaaaacagaagaaccagcaacttttgatttgcaaaacaaaaagtttaagacggcgtactttgatttagtacatcatccgttggaagaacaaggtgtcgatttctggtggattgattggcaacaaggtggagctcgaggacaatctaaggttgatccgctctggttactaaatgttgctcattttcgagatagtgagaaacggcatgtaggggaaggcttaattttatccagatacgctggacctggcagtcaccgctatccagttggcttttcaggtgatactgttgcttcttgggattcacttagatttcagccatactttacagcgactgctagtaatattgggtacacttggtggagccatgacattggtgggcatatgcggggaacatatgatggtgagttatcgttacgttggttacaattaggtgtttttagtcctattttgcggctccatagctctaataatatctttatgggtaaggaaccttggaattacggaaaagacattgaatcagcaatgattcatttattacagttacgtactcggctagttccatatttagatagcgaaaattatcgaacgcacactgaagggctgccattagttcagccaatgtattatggttatccgaaccagaaagtggcttatgaggtgccgaatgaatatcaatttgggagtgagatggtagtttcgccgattacgacgcctgtagatttacaatctgaactttctagtacagaagtttggttaccagagggtcaatggtacgatttcttcactggtttagcttatgaaggggatagctactttaaggcctatcgagaacaaaataaatttccggtatttgttaaggcaggtagtattttaccaatgcttaagaattatatgcaaccgttagcacaaattcctgaacagttggaattgatgatatttgttggtacggatggaatatatgaaatggttgaacaccaggaaaataacatagcaagaactatattcaaatggaacgaccgagagcatcaactaactgttgagacagtggatccggcaaagctgattccagcacaaagacagtattccgtaatactgattggtgctgaaggtagtatcgataagcagtcagcaacaactatctcatttcggaattaccaactgattgaccaatctaaaatagttacagaattaattaagtcacgattacaaagggcgcagattagttttgaagagaaacaattaatttggcagatgtatgtctctcacaaggaaactaaaaagctaattaagtttctggatactatacatgagaacaccattcgggggatgattattgagctagtggaaaagtaattttgagataaaacgatacgtcttgattactggattatgtgtgtaccagtaggcaaggcgtatcttgtcatttgtaaactaattatttatataataatattattattttttgcaaccggttgcaaaaaagtgcgtaacgctctatatttaaatctatagataatccagaacggaggtagcagaatggcaactattaaagatgttgcgcgtcgcgcaggagtgtctccgtcgacggcatcaagagctcttcataatagtcatattatcagtgaatctacacgggaacgggtggcaaaagcggctcatgagttaaactatgcaccagatttcaacgcacaatcattagcaacaaaagctagtagtactgttggtgtgattttaccggtcgatcaccatgagatattttccaatcctttcttcttggaaatgattcggggtataaatgaggtctgtagtagtagagggtcgctaattacattagcaacagggacaactcgaaacgaacttttgcataatatcgatgtcatgattgtgcaaggtcacattcaaacgtttattttattatattctgaagaaaatgatccggtagtagaccgtctaaaccgggataaaattcagtatgtggttattggcaaaccatacacgggtgcaaatagaatatcatatgtgaataatgataatattcaagccggatcagacgctactaagcacttattatcatatggtcatcgaaatatttgcttcttgtattctgatttgtcaaaaatggtccaaagcgatcgcatgttaggatatcagcgggttatgatgcaaaacaacttgccagacgttgtttttgaagagcgcttcgaaagccattcgagtagttttcaggcgttgaaaaagttttttgctcagcatacagatgttacaagctttgtagtagtggacgacatgttggctttaaaactacagcaaatgttacacagtaattcagaatggcaaaacaagcaattgtcgttaattggttttaatgattcaatattctctgagcttgctcatcctaccctaacgtcggttgcagtatttcctgaacgactaggaaaggaagctgcaaaaattgcaatggtagatcattcagaaaatgagctttcaacagctgtaatagttccgcatcagattgttgtccgtcattctgtatataaaatttataataatatataaatcaagcaataagaggaggaaattgataaatggcgacattgagtgatgtggcgaagcaggccaatgtttctaaaatgacggtgtcacgggttatcaatcatcctgaacaagtacgagatgaattgaaacggagcgtgtttgaggctatgagacaactagactatcggcctaatgttgctgctcaggcactggtaaataatcgaacacaaatcattaagttattcattcttgaggatatggatacaaccgagccttattatatgaatttgttggctggaattgcgaaaaagcttggaaaggaacaatactcattgcaattgataactgagcataactttgatatcgggggatgtgacgggtatattattacaggaatgaggcacggagactacgattggattagaaacttagaacgaccggtagtactgtttggtgagaatcgtgaaaattttgatttttgcgatactaataaccaattaggcgtgaaaatggctacagattatgcaattaaacaaggatatcaaacaattgaatttattggtatggcagtcaaggagccatttgagtattctcgtgaggcaggttatatgatgagtatgcaacaacatcggatgaatacggtcattcatcggtttaataatcatagccatttaacaatggactatatccaacaaaattggggtactttacattctaatacgtgctatatttgcgctagtgatcggttagcgtttggtattgaaaaagggttgtctcgttttagtgcaaatattcctattgactttggaattattggttttgatggtgtgtttttgaatcaggtggctacacccaaaataacgacagtacaacagcccatttttgaactgggtttacgatgtgcagaaatgttactagcaaaaattgctagtggtgggcaggctcagggagtttgtcagttagtcccaacattgtcgatagctggttctacgcgcaacaatattgtataaacatcatgaaacaataagtgatgcacataagtcgttttccacgctaaaagtgttaccgctaacaagtataattaacttgttttagcattctattgtgggtaatctgaacatgactgattatggtcgaaaggggagactgtcgtggaaagttggcacgcgaatcaagtgatttatcagatatatcctaagagctttcaggactcaaacgaggatggtgtgggggatatccaaggaattattcagcgaatcccatatttgaagtctttgggcataactacaatttggttaaatccaatctatgtttcacctcaagttgataacgggtatgatgtttctaactactatgccattgatgagacactgggatcgatggcagatgttgatctattgattaaaagactgcatattgaaggaatgcacttaatcatggactttgtgatgaatcatacatcagatcagcatctgtggttcaaagatgcaatacaacatccacatggcttgtatcgtgattactatttatgggcaaatgctaagggagatggatatcctaataattggggttctttctttgggggaagtgtttggagtatagacccaggcacaactgatcagtattactttcatttatttgatcgtcatatgccagacttaaattggcataatccagaagtccgcaattcaatgttggaaatcgcgaagtattggattgaaaagggaattgatggattacgactggacgcttttattcatatcgagaaggctaactttaatcaagatgtgccaaacgattcaaataaaccagttattgccgaggagttttatgctcacttgccgagagtgcagacttatttaaaacaattttgtgcgcaactcagagcaatcaaaccagatatctttatattgggtgaggccgcttcagccagtccagagttgttgatggaatatagtcggccggtgaatggtgaatgcgatgcggttattacgtttaagtctttggtagataaggttgaaaatcccgatataaagttacctacaacctttcagttgaaacagttggatatagaaggcatgaagcgccaattagcggcaattgaaacaaaacttgcggatgttagtttaccagtgttgtattggagtaatcatgatatggctcgattggctagtcgctatgcaagcaaatgttaccgcttacaaagcttgaagtgtctagcaaccatgctgtacctacaacgtggaattccaattatttactacggtgaagagattggaatgcaaaatttaagtcaagaacagccaattgatttttgtgatcaaacggtaattgaattctataagcaggcattgaaacagggctattcgcatgatgatactatgcgaatgcttaatcatacacacaaaatccctgcacgtggtggaatgcaatgggatttgcaacaaactaatgcaggcttttcggaacatgtaccatggttggacggaacgacgatcgcggtagatgttgctactgagcagaccgatccacatagtttacttagttattatcgtactttgatcaagcttaagaaaactgaactatttacagacggtattgaaattatcgagaatacaactaagggtgtgtttcagtttactagacagttaggacgttctgtagccgtggtaacttgtaatttgaccgatcaaagcttggatattccacagattcctgctgcacatcttcaaatggttgagggagaagttcagccatctggagatatgatgacatacggaccatgggcatttacaattaaacatgttttggaggaatgactaacaatggctgaaaatacatcaacaatattacgtaataaattagtttattcagtatttcctcgtaactatacgagtagtggaagctttaagtccgtgagagatgacttggtgcgtataagaaaattaggaacggacattatttggttaatgccaatccatccaattgggcgtaaaaatagaaaaggtgccttgggatcgccatatgctatttcggactatcgtgcaattaatccagaattaggaacgatggaagattttattcagttatgtcaagcgatacatcaacaaggaatgaaagtgattatcgatgttgtttacaatcatacctcaccagattctaagttactgtcagaacatccagactggttttatcaccatacagatggacaccttggtaatcgggtagctgactggtcggatattattgatttagattatcaaaatcatgatttgtgggattatcagattaatactctaaagaagtgggcacaatacgttgatggattcaggtgtgacgttgcgccgctgataccattagatttttggatgacagctcgtcaggaactggaaaatttcaagcctgatttaatttggttagcagaaagtaatgatccagattttattaagcgtgtccgtgattctggatttgaagatttgtcggatggagaactatatcgagcatttgatatggtatacgattatgatgttttagatgatttacatgagacagttgctggaaaagaatcagtcgcagaatttagtcgtttgttgcagcgacaagacattatttaccccaaaaattatattaagatgcgtttcttagagaatcatgatgttcctcgtgcagcagagtacatttcggggaccaaatctttgcgtagtatgatagcatttaatttgtttgagaagggaagtagtttgatatatgccggtgaggagtttggcaatccgcatttgccgagtctattcgactatgatcctgtgcaattgaccggtccttatgattttagcatgctaattaagcgaattatggatgtaaaacacgaacaaataaacttgtttactaaaggtgcttataatgtgacagctatcaatgaagaaatcatcaaattgagataccagaattctatgcagcagattactggctattttgcaatacactcctttgaaggggggatagaagctgacttagagaatggcatatataaagatgtcctatcagaacgcgacattgtcgtaaaaaataacaagctggtattcaatggagaaccagttattattattaactaactaacacaataattttttgaaataattattgagcggtttgaaggtgatttaaaatcactgacaaaccgcgttatttgtatgaattatggcaaataagtgttggggcaattgttgaattttgcaaacgattgcgtgttttacgcatgctaaaaatagccaaattagaagggtttatgaagcttatgtgaattttgttagcgataacatttcgaaaccacttgcgtaagcgcttacaaaattgcataattagattgttataaaggttgtgtatttttaataaatttaagtagggggttacattatgacaaacggatggaaaaagttaggcgtttcagttttagccggcgcaatggcattaacattggttggttgcagcaatagcaattcttcatcgtctgacaagaaagttaagatcacaatttttcaggggaaagtagaatcgaataagcaatttaaacaaattgcggctcgttatcacaaattacatccaaatgtatctatctcagtttcatcagttggtggcggtactgattacagtccagtccttaagacgcggatttcatcaggaaatgcaccaacaatctttagtttggctggcccagccgatgtaaagcaatttgcatctcaggaggcagatctgtccaatactaaagctgctaaagcggcacaacctggtactttatccgcagttaagtcaaacgggaaaactgttgggttaccatttaatgttgaaggctatggctttgtttataataaaaagatttttaaagaagcaggcattgatgcaaccaagttgactaccatgtcgaagttaacagctgcggttaagaaaattgattcacaaaaatccaaacttggaattaaaggtgtctttgctctaccaggcaaggaaacatggattttatctgatcacttagccaatctatatgttgggcaacagtttaaaggcaatgcgcttaaaatgtataattctaagagcatgaaatttactgccaataaagaaatgaaagatatgattgatttacaaaagcagtattcggttggcccagttatgcaactagactattctgctcaagttaaccaaaacttctcacaaggcaaggttgcaatgattcaacaaggtgattggatttatccaactgttgaacagattgataagaagtttgcccaaaatgatattggtatgattccaattccagttaagggctatgaaaacaaattgcctgttggaacttctctctattggggtgttaacaaaaataagtcacaagctgaacagaaggcagcaaaggacttccttgactggatgtatacttctaaagaaggtaagaagttagttgttaataaactacactttgtacctgcatataaaggttatagcaacatgaagatgaaagacgcactgtcccaagttgtctttaaatactctaagcaaaacaagaccattggttgggcatttccagcgtatactggtacttcgtgggatccaaacacgttccaaccaaacttacaaaagtatctatctggcaaacaaagctggacaacaactgttaataactcaattaaaggctggaatgaacaacaagcttccaagtagtttgagttagcggttcaaacagattttaaaagaggggattatttatgaagaatcgaagcttatcattctggctctttctgacgccaaccctcgttgcgttagcgctcgttgttttcattccagctataatgggtgtcttttactcgttcactgattgggatggcttgggctatactcagattctcggttttaaaaattacatcacacttttccataatgccggtttcttagcggcactgtggtttaccgttaaatttgtaattgtaaccgttatcttattaaacgtaatcggtctaggattggcactgcttgtaacacagaagtttaaaggaaataatttattgcgaaccattttcttcatgccaaacctaattggtggattgattttagggttcatttggcaatttatctttacacaagcttttgatgcacttggtaaagcgttccatatgaattggttaacgggatggttaactgacagtacaaccggcttttggggattggtaattgtgaccgtatggcaaatgagtggttacattatgatcatttatattgcttacttacaaaatatccccagtgaggttattgaagcagctgaaatggatggagcttctccatggcaacgatttattcatattacgttcccaatgattgcacctgcattcacagtttgcatgttcttgacgttgtctaacgggttcaagatttatgatcaaaacttatcattgacgaatggtggcccatacaagtcaactgaaatgctggcaatgaatattgttaacacggcatattcggagaataattttgctttagcggaggcaaaagcgctaattttcttcttgattgtggcagcaatttcgttactacaagtttactatacccgtaagcgggaggtggatttgtaatgaaaaaaacaagtcggctattacttggaatttttggattgctcttagggattgtttggattttcccattttacatgattctaaccaattcatttaaaactccaaaaggtatttttgcatcagtattgagtttaccagtgcaagcaacgactgaaaactataagaactcttttaaagcactggattttatgagctcacttggtcattcgttcttgattacattggtatctgtactcatcattgtctttttctcctcgatggctgcgtatgcgctacaacgtaataagagcaaattaagtggcgcactgttgatgttatttgtttcagcaatgttgattcctttccaaacggttatgattcccttgactgctaattttggtcatgtccacatgcttaatatgtggggactgatgtttatgtatttaggatttgatgccagtttgtcaatctttctatatcaagggacaatgggaagcattccaattgcgatggacgaatctgcagaattagagggtgcaaataggttccaaatcttctttaagattatttttccaatgttgacaccaattactgtaacagtgggtattctcaatatcattgcgatttggaatgactacctattaccatcacttgtgttaccacagaatcagtatacgattccgctacaaatgttcttcttctttgggcagtatacgaaacaatggcacctggcattagcaggactaacattgtcgattattccggtaattctattctatgcctttgctcaacgctatattatcaaaggggttacggatggtgccgttaagtaagtagtgaaaaataattcagaggggaggattgctagatgttaaacctacaaagtaaatttgggttaaaaatgttagcaattggtaactggattgctgctatagtgaccattaaccttgtttggtttatgataacgctgccggtgttaattatgttagtcctagcattaagtttgccaatgaatgcagtttatggcatcacaattctggttacctggattatgctaacagcgtttacagttcctgcaatgtctgcagtttatcaaacggttgacttgtggcaacgaacagatagcggttcttttatcaagataacttggctgagttatttgaaagcgctaacgaattggcgattcaacgggctggtagcactagttattggttgttggctgactattttacgagttacaacggacaatgttgtacttcacgtggcgacactagtgattggtactgtactactagcattatggaatggaaaaaattatagtcaggcaatcaatcagcgctttcttgagttagttgtggcgcatccgttcaagttattgttatcagcgattataatgattggactatttgcgattaacttggaattacgattgatattcttcatattgttattcagcatgtcactttcggcgctaataacatgccgtttgttcaattcatatactaaaacagataaggaagaagagctgactgaaaagaattaattgaggataagaggagcgtttgcacgatggcagaaataaaattagaacatatctataaacgttatcccgggaatgataaggattctgtaactgactttaatcttgatattaaggacaatgaatttatcgtttttgttggtccatcagggtgtggaaaatcaacgacgctacgaatgattgctgggcttgaagatatcactaaaggcgatttgaaaattgatggtgaagtcatgaataaagtccatcctaaagatcgtaacattgcaatggttttccaaaactatgcattgtatccacagatgacggtttttgataatatggctttcgggttgaaaattcgaaaaatgcctaaagatgagattaaaaagcgagtggacaatgcggcagagattcttggattaaccgactatctcaatcgtaagccaggagcattatctggtggtcaaaggcaacgggtagcgttaggccgagcgattgttcgcgatgcaaaattgtttttgctcgatgaacctttatctaacttggatgcgaaattgagggttcaaatgcggactcaaattgcacaattacatcagcgattgaaaacaaatatgatttatgtaactcatgatcaagttgaagcgatgacgatggctgatcggattgttattatgaatgacggtaaagtccaacaggtcggatcgccggacgacttgtacaatcgaccaacaaataagtttgttgctggtttcatgggatcaccgtcaatgaacttctttgatgcagaactaaaaaatggccgagtttcgaatggccgaggcttagatgttgcggtacctgaaggtcgccttaaagttctacgcgaaaaaggctacgatggtcaaaatatcattgtgggaattcgtcctgaagatattcacactgaacaagtagctttggaagcaatgtcagacgctaaagttgaagcgactgttgaagtttctgagttcttagggaccgattcaatgttatactcgcgtactggtgacactgagtttgtagcgcaggttaacgcacgtgattaccataagcccggtgaagaagtagatatggcgtttgaaatgagtaaggctcatttctttgataaaaaaactgaattaacgattgaataatcattagtcagggcggttatcataacggaaaaaggctggtggcataattgtcgcgagccttttttaccgcctgactgggaggagcaacaacaatgaaacgtatttttgaagtagatccgtggcacgtcattagtcatgaactcgtaccgacggataagcgattgcaggaaagcatgaccagtattggtaacggctacatgggtatgcggggaatgtttgaagagcactattctaacgataccctcaaagggatttatatcggtggggtctggtatcccgataaaacccgggtcggctggtggaagaacggttatcccgattatttcggtaaggtgatcaattcggtcaatttcatcaaagtcaatatcacgattgatggtgatcaagttgatttggcgaaggacacagtcagtgactttacgttggatcttgatatgcatacgggaattttacggcgttcatttattattaccaagggtgaaaagcgcgtccaattcatgattgatcggttcgtcagcgttgcacaaaaagagttatttgatgtgcactatagtgttcacaatttgggtgcggaaccggtccaaattggatttatttcgcaaattgatgcggacgtcttcaatgaagatgcgaactatgatgagcagttctggcaagtgctagacaagagtcatgcgattactggtggcagcatgtttgcagaaacgaagccgaataacttcggaacaccgcgctttacgctcggcatgcagatgcttcatgaaacggcttttcgaggtattaacgccccagaaaccgaaaaggcagttacaaatatcttccggggaacgttagcaccggatgaaaccaagaattttgaaaaacgagtcctcgtggtgacttcacgggattacgcggatatggcggcgatgcggactggcttagccgaattaagtgaaacggtcagcacacagtcatatgaggacttacggcaggcccatgttgatggttgggctaaacgctggcagttatctgacgtgttgattgacggtgacgatgcggcacaacaaggcattcgcttcaacttattccagttattctcgacctactatggcgaagataagcgcctgaacctggggccaaaaggctttactggtgaaaagtatggtggtgcgacgtattgggataccgaagcgttcggagtaccgttctacctttcattggcgaaaccagaagtaacggagaacttactggaataccggtataatcagcttgctggagctttccataatgctaaaatgcagggcttggctggtgccttgtacccgatggtgaccttcaacggaattgagtgccataacgaatgggagattacgttcgaagagattcatcgaaatgggtctattgcgtatgccatcttcaattacacacgttataccggtgatgagatctacttgaagactaaaggaatcgacgttttgacggggatttcacgtttttgggctgatcgggtccacttctcagaacggaaacaacagtatatgattcacggtgtcactggtcctaatgagtatgaaaacaacgtgaataacaattggtatacgaactttatggcgcgctggacgttagaatacacgttagcgagtttgaagaaagtggatgccgctaagcgtgcagcacttcaaatcacggatgctgagcttgcaaagtggcaagatattgttgaccggatgtacttcccgtatgatgaaaaattggaaatcttcgttcaacaagatggcttccttgataaggacgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgatttctatgaaccgttgaccgtccatgaatctagtctttcaccagccgtccatgccattctagcagcggacttgcattatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtgcctaaagcgtggacccattatcaattccacgttaacttccgcggtcgcttgattaaagtggatgtcgatcaacagggtacgaccgttgaactggttagtggggaaccactgactatcgaacttaatgggcaagctatcgaggtcgctagcaccgtaacaactaagtaaatatgaacgcttgattgtggtctgaccgtaactggccacaatcaagtttccaacctaacttctaaatcggtccgtatcagctgatacgggcctttttagtgtctggacataaaagagtccctcacttggaaatatcgatttccaagtgaggggctcggctgttctattcaaatagcatcggtagggttatttgagtgtttgcgtcaatcctagcacgtccatttcgtaaatccgaacggcggtgtcagcaacttgggttggtttatcgacgactaaccggacgtagcgcgccgaagtagccgcgaaagtattgagactagtggcttgcgtgttattgtaggtccgggcaacgtccgtgtagcgtttgccatcagtgctaacctgaatggtccaagcgcgggtgttcatatcagcaccttcgccaccagctttggcatgcgctaatttaaccgcactcacagtcgtttgacggcctaaatccagcgtcaaggtatgcggtgccttaccggttgcacaccatttagtatcgagtttcccatccgccgccattttaggtgcttcactactattcgtgtatccggaggcactggtcttggcgttcttggatagtaaggttaaagcgccttgagctttcggtgtaatcgtaatgagctttttcattgtaacgtgccgttggccatccttatttttagcggttaatgtgacgttataagtgccagccttacggtaagtgaccgtggggtttttggcggtgctggtcgtctttgtggcaccgtcaaattcccatttatagctggttgcgtttttggatgaggcatttgtaaacttgatcgtgttaccgggagctgccagggtgcggttaaccgtaaatgccgctttaggtttacgattatccggccattttaaggtaacttggtcagaagcatcgccacgttggttccaaatatcaactggaacgaccatcagattggtctcgttgtgctgcccattccgtttcaacgcgtttaaatagaaattagccgtgttagtggcccccagaaatgagcgagaaccgtcattgttaacctgataaatttcgtaatgatccagcttatttttagtggtggcttgccaactcaggttgacaccggcgtacttgccttcttcgtcgaaggtccgattatcaatggtgacctggttgacctttttcggcgcggcctgctgcttgccggtaattgcgaggcgacctaattgaacgctgtagctagcatcagtctcggcggcactgattttgaggctaaggcctttgattgttttttttgttaactgactaacgtcatagctaacggtcgtccagtgcttgctgagtgtccggtcacccgcgatggtcttagtgcggccgtcctttaaggtcaccactagtttagctgtagatttaccagatgccttagcggttaaactaacctgggtatcggcagtgacgtctaggtccgtggtgtagagtttgattgtgctagcggtgtccttacgcattttgccggctaacttgatatcattgccaccttcgtaggcgtcagtgtagtcaaagctggcctttaacgcattaccattgcctaagctgaaattagtgacaaagggctgtttcgtaatggcactttgttcaaccgcgtatgttgaaacacccggccaatgtgttgaagtagttgacggaatgctacgggacggatcattttgatcattgacccacagagcaccttctttggcttgaaattcgtcaaccgtatcggaagaagcgtgtgtccagtccggtgcgtacaatcctagcgacgtgtatggcacatgttgtttattagcgaatagattccaacgaacgggggtagcggttccggcagcttgaacatcgattcctgcaaagaggttgtaaggactaatcccaagcttttcggcgcgttcgtgtgactttttgagtaattcttgactggcgagacgcttcttcgtccaccagaagttaagaaacatcgagtcagcaactggtttcatattggcatcgactagataagattggttttcttttgccaatccattttaccatccttcgtcatcgagtcataccacatcaggtctagcttggagccggccttttgtttgtattctttgattaactgttgcattagttgggcgtgctttttgctcagcccattactagttgagctggttgcggtctttccggtggaagccgaatcaaaacttttaacttcggggtcggtctcttggttgatgaaccagccgtcaaacccgtaagctttcgcaaccgcgactagtttatcagccatcggaaaatgtccgtcagcatcttgttttaagaagtcattgagccactttaacttcccaccactaaccacttgtgggaagaaagcggttccaagaacgggcacgccgtttttatgagcagaatcgatgacatctgcggtcggtggcacaatcaaaccttcgcctgccgaaccgccccagtagacgagttggtcaatatactgccagttggagaagacattcgcatcgaacgtattaatcccgcgaggcgcgttgccactagttgaactattcataatggataacgcgacgaccttcatctttgggtcctgggtcttgttaaccgtcggcagttgccatttatcgatccgtttggctagtggaaccgaggcggtgttgtacttggctgctttatccttgctcaactgccatttcagcagttgttttggaaaccagtacggtgcttcgggttgattctccatctccttatcaagggtggcctcagccgtttgacggtaactgatctgctgattagctgactgtttcgaacaagctactaaacctacagcagtcgttatcaaagctagtgtgccaacaatgtagcgatattgtccatgtctcatagcgatatcctcctgtgaactaagcaaaattgacatatccgcattatgtgagcgatgattgcatgaatcgtaattaaaacgtggcctcgacttagatttttgactaccgcgctctggcaattggcagaaatgcctggaggtcggtgtagggtgaactaagcatgtttacgctgacccgaactctttccagagagcctaagctgactgcttttgacgttaattattttgcctactttaatcatgactcatgacaaattagctagcacaacgcgtaaaatacaaaaatctatatattgctggtatgtatgatatcggtttcagtgacagatgagtatagctaaattaagggaattcttccacaaattaaactaattgatagggtcaatcaattttgatgtaaggggaatgctgggtttcaacttgcgcgcaacgtgcgaatagttgaggattgttgcggtgccgatacaatttaacgaacgcgaatttttgcgtgatgagtggtatgtagtataataactagctaggaaggtgattatttattaagtataaagttgataatggtgaatatcccagtggtaaggacgctgtggatcccaagcgagtgaaatatctgaaattgattagtaagttagcgacatttacgtgtattgcgatgtacgtgtcgtatattccacaaatcatttcgaatttctcaggtgacccagtatcgccgctacaaccactcgtggcaatgattaatgggatactatggactggttacggctggttcaagacttataaggattggcccgttattatttcaaatgttcccggggtgatttttggatttatcactgttttaaccgtatatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttgggacgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccatatattcattaaccgaatgacaaattgactgtaaactaaaagtccgctgatacgtttaaacgcgtatcggcggacttttttgcaaggtgttaagcgttctttaaagcagcctgagctaacaataggccaccggcaatgccagaattgttacccagtccagcgggaacgatatagtcatccagtggtgggacttcttcgtagccatttagataggcggcaaacttttcacgaatcatgggaaagagctgccgttgattcataacaccaccgttaagaataattttatcaggtgcgaaggcgacggtgaggttgacacatgcctgtgcgatgtagtcagcgatgattggccagaccggatcgtcgacgggaatatctttcccagctttccccgttcgttttcccactgctggcccagcagctaaaccttctaaacagatgtcatggtaggggcagttggacttgaaatcgtccccaggtaaccggttgagtcgcatgtgaccaagttcagtatgagtgcgaccattaaaaatgtggttctgactaatgatgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaaatcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttgaaaatgtagtcttatttattaatagtatactcttaattagaaattttgttaacgattacattaactttgacgtaaataaattagctgactagtgaaatcagcgttggtgggtttaagtggaattcccatcgtgtttaactgatgccccgtatagcgattacccgatgaatcgctataagttaattcagcatcgagatagtgtaatggtaatgggtgctgagttttgacagcagaattaagcctatttaagtaacagcaaattgcctgctttttatctgccgttactagcaaccacgcaacaacgtgtcttgttgtcggtagacgataaaagtgggccttgataaaagtagacttcagttgctgatatttaatcaaggctcctcgaagaagttgctgttcactaggagcaagttgtttaggattaagttccaatcctagttgcccgatgcaggctaattgtaatcgagtttcaaatggtgttattcggccattttgcgcattgggtgatgcggttatatggttgctgaatatccgtggtggaaatagataactaaatccgttctcgatggttgctcggtcgactggatcagtcaaatcgcttatccacgtctgattggtgtatggtagcataccaaaatcaaaccggccaccaccagctgaacaattttcgataatcagcttggggcaggcgcgcttcaagcgtgtgagaatatcataaagtccacagacgtagcgataatacagttccccctgttgtgcagccggtaagcgtgtgctgccaacctgtgtaagatggcgattcatatcccatttaaaataatcgagttggttattttgaaccaagttcgtcagagtagtgactaagtggtcacggacagcagcctgcgaaagatctaagactagctggtggcgagctgtgatgggtgtccgatcaacatattgtaatacccagtcaggatgttgttggtaaagctggctgttagtggtgatcatttctggttccacccagagaccgaatttcattcgatgatgatgggcttgttgggcaaggggtttcagaccattaggaaacttaatggggtcaacataccagtcacctaattgcccattttcaccgttacggttgacaaaccagccgtcgtctaagacaagcatttgtaagcctaactggtgggcgtgttcgattaagtgttgaactttagactctgaaacggcaaatgtcagtgtttcccaagtgttaagcacacttggaatgttagtctgggagggcatcagctgatggctaaagtcgtgaaatacttgtgacatgccgttaaaaccagtatttgtccaagttagcacggcttcaggagtctgaaaactgctatttggtttgagctgccattcgaatgtatctggttcaagaccgattgttaggcggctatgttgatattggtcaacttcgacagtactgtcgaagttaccactccatgctagtgcacaaccaataacagtcccagctaattctgtcgtgttaggttctgctagagccatgaacggttggtgttgtggtccactagtgccgcgcagactgcgaaccgtttgtaaccctgggtgtaaacggttaaacgatggattagcttcatgtgcatgggtaccgcttaatgtcagcgcagtatattggtcagttggtagatctagttgagcgctggatagggctgttacttgcaaattagtagtgccgtgatggcgcagagttgtgcttcgcaagataagcggctgattttcaaaaatagtgtagttaagatccatctgtaacttggtcactgaatcggccaaatgaatgactagggttgttacaggcgtgtgtttgctaacggtgggtggcaattggcgcgagttgattggctgatcattcacagaaaaaccggtatattctaaaattggcagtaattgattgttagcatccttaataacgtaagctggctggcgatagtcaccactgccaatagtggaatattcgagtggcagtgaagtcacggaatatggaaagcgttctgttgggtcattagcaaaagcatggctaccggatggcatcggctcaaagtacggttgttttgaaaagtaacgtccaaaatatcgatgcactgggtaacgatgggctaaaatttgaataacatagctaatttggtcattatgaagattgattaagccggttttggggtcatattcaacaggcatgacgtcctcctaataaagtttagacagttgtagcagcaactgagctagctgccggttcagtcagcgcaacgagctgttcaccagcttggacattcgtgactttgagtcgttcaacattagcgtaattggccgtatttgtgacgactagcatgacggttggatcatagttagcggcttttaaggcagcgacgtcaaacgttccgagtagatcaccttgatgaacggtatcgcccttctgaacgttagtagtgaagtgttcaccatttaaattgaccgtatctaatcctaagtgaatcagaatttcggcaccagcagttgttttgatgccataagcatgatggctatcataagtgacagtgatgaccccgtcagctggtgcgacgacctgatcagcgcttggcacgattgcggcgcctttacccatgatttcggctgagaaaacttggtcgttaacttgtttgagactttcgctagtccccgttactggtgcactgataatctcatcattaacattgatgacggtactcgttggtgctggtgattttacttgatcatgatcgtcaccgagtgttcgtttggcatagataaaagttggaataaatgcgacgacaaacgagatgacagcactgagcatgaatgctggaatcgactttgaagcaatcgaaatgaacccgatgactgatgcgggacccatcgccacggacagaacgtggaatagtcctaagaaagctgaagcaattcctgaggcaatcgctgcaaagacaaatggaaatttcatcttgaggttgaccccgaaaatagcaggttccgtaattccgagtaacgctgagaccccggctgaagaagtcagggctttttgcttttggctcttagtggcaaagaaaatagctaaagtggcggcaccttgcccaatgttggccatcgaggcgactgggaagataaaagaacctcccgttttggcgacgttagccaataactgggtttcaatagccgggaaggtttggtggagcccagtaatgacaatggccgagtagagaaggccaaagatgcccatgccaatccaaccagtcgtgttatataagcctactaaaccgttagttaatgcgtcgctcaccgttcgtaagacaggaccgacgattgtgaaagttaggaagccagtgatgacaattgcaaacattggcgtgaacgtaaagtcaaatgcacccttgatatgtttgtggaagaacttctccagagtagccaaaatataagcaacggccaaaacagggagcacttggccttgatagcctgcttgtgcaacgtgtaaaccaaagacgttccagtaaaccatcttgccggcggccatggtcgttgcaacgctatagccgttaacaagtgatggtaagaccatgatcatgcccatcgtagcacccagataggggttgccgccgaagcgcttcgttgctgaaaatcctaagagaattggcaagaaagtgaacggggcactagccatcgcgttaatcatttcggcgatacctttgagaccgggggaaacttcaacaactgacttcgccataaaaagatgctcggcagtcaaaacgttgtttagtgccattaatagacccccagcaactagtgcagggacgattggaataaaaatatcagataagactttgaggaagtccattaatggatttttcttttgacccgcagcggcaactgccttgatgtcatcgggggtcgcttctttaagacctgttttggcgattaaggcgtcatagactttatcgacatcgccagggccaataatgatttgatattggccgttagtttcgaaggtccccttaacgtccgcgtcgtcatctaaggcttgttgatcaatcttggattcatccttgatgaccaaacgaaggcgtgtcgcacagtgggcggcggcttgaatgttgtttttaccaattgcattaagtacgcggtcggcaacttcttgatgattcataataattcactccctgagtctaaaattatttttaatttaataatgcaagcgctttacagacccaataataacaagtttggaaaatatgtcaagcgtttgatacaaaattgaattgcttgataatcttgttaaaaagccgaatttgaaacgctgacatgaaaatataatataaaaatgtcaaacgattgacatatcggtgtaagcggttttataatagtgacaattaagtcgaacgttaaaaaggagctcatcgtcatgatatggaatcgtaaaacccgttataccccttatgaacagtggccagcaactaagctaccacagcttgttgcccaggcacgccaatctaagtggcggatgcaacatcatattcagcccgcatcaggtttgttaaatgaccccaatggcttttcatactttgatggtcagtggcacctgttctaccaagtttttccgttcggtccggtacacggactgaagtcatggcaacacgtaacctctaagaacttggtggattggcatgatgagggcttagcgattcgaccagatacgccgtacgactcacacggcgcgtacacgggtacggcactaccaattgatgatcagttatttattatgtatacgggtaatgtccgtactgctgactggcaacgtgaatcgtatcaattaggtgcctggatggacacggataatcacattaaaaagctgtcccggccactaattgcgcatgctccggctgggtacacgagttcgtttcgtgatccggacttgatccgtactgaccacggctactacgcgttgatcggtgcgcagacgactactgagattggtgctatcttggtttatttctcaaaggatctgaccacctggatgtgtcaaggcgagttaaacgttcccgcagatgcacggggttacatgattgagtgtccgaatctggtctggatcgatcaacagcccgttttactgttctgtccccaagggttatcacaagcaacgactccgtatcagaatatttatccgaacatgtacttagttgccgatcaattggacctagctcaggcacaattaactgacccccacgccctgacgcaattagatgatggctttgacgtgtacgccacgcaggcaatcaatgctccggatggccgcgcgttagccgtcagctggattgggttacctgaaattacctatccaactgatcgtgaaaattgggcccattgtttgagtttggttaaggaactaacgcttaaagatgggcacctctatcaaaatccagtggcagcggtggatgatttgcggacgacggcgcatgacctagtctttgagcaacaacgggcgacggtagcggctttgaatggcagctttgaactcttactgacggttcccgctgataaaacggtcacagttaacatcgctgatcagcaagaaagtggccagctgcaggtaactgttgatgccaaccatggtcaggtcatgattgatcggcggcatacgggaaattcgtttgctgaagattatggtcagactcgtcaagtggagttaccggcccataagacgataaaaatccggctaatcatagatgtgtcagtctttgaatgctatattgataatggctattccgtgatgaccggccgtttcttcttaaacgctaccccgagtcgccttaacgttcaaggtgacactacggcagtcaccggtaaagtctgggaatggcaccaatcagagcatactggagtcgataacaatgaaaccaaaattaaatgatgttgcgaagctagcgggggtctcagcgacaaccgtttctcgggttattaataaccatggctacctgagtagtcagactaaagaaaaagttttcgcggcgatgcgagaactgcattatcagccgaataatatggcacgctcactgcaaggaaagaatacgcgcttaattggcgtcatcttttcagatattagtaatccgttctttggtgaactggtgtcccggattgaaaaaatcttatttgctaaaaattataaggtgattttatgtaatagtgcggatgatccgcaaaaagaacgcgactacttacaaatgttgatggctaatcaggtcgatgggattattgctggtgcccacaatttaggtattgaagaatatcaacaatacggccttccgattatttcatttgaccggtacttatccgacaatattcccatcgttagttcggataattaccaggggggctggctagcaacccagacattgcatcaggcgggggcgactaacgtggctatttttactggtaagtcacacgctggttcgccaacgaatggtcgccgtgaaggatatgaagcctacttgactgcccaacagctaacaccccatgtccacgaattaccgtttgaattgacccccgcgctgaagatgatggaaattaagacgattatgacacaacatcagtatgatggtattttttgtagtgatgatttgaccgctttactagtgctcaacgtcgcgcgacaactgtcattaacggttcctgagcaattacgcgttgttggttatgatggcacggcgctcatacgtgattatcattctgaattaacaacagtagaacaaccgttagcggatattagcacgttactggtttctctactattgcagcggattgaggatgcgaattgtacactggaatcaaaatatacgttaccagttaagctcatcaagggccttaccgcgtaactaaggagttaatcgtaattatggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaattattgcaagccgcccatgaccggggcttaaagatcatcatggacttggttgttaaccatacctctgatgagcatccatggttcaaacgcagtcgccaggaccgcaccaatcaatatcgtgatttctacttttggcgctcaggtaacggcaaaaaggcgcccaataattgggatgcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccgggttaccaaatggtccactgaaaccgcacagtcagtttggcgatgctcgagtaacgaacggaccgcgagttcatgaattcttgcaagaaatgaaccaagaagtgttgtcacagtttgatatcatgacggttggtgagacccacggggtgacaccagcggatgcgctgaagtatgcgggcgctgatcggcacgaattagatatggtctttgaatttcaacatctgcgacttgataatagtcagcatggtcttggtaagtggagtacgcgtaagacgccgttagtggcactaaagaaagtcattagtgactggcaagtcggacttgaagggcgggcttggaacagcctgttttggaacaatcatgatacgccacgagcggtctcacgttttggtgatgaccgaccagcatatcgggtacgttcggctaaaatgctcgcaacgtgtttacacctcttgcagggaaccccgtatatttatcaaggtgaggaactggggatgactgacgctcattttactgaactagccagttaccgagatattgaatcgctcaatgcctatcgtgatttagtgactgagcgccagctgctatcaccggcagatatgatggcccgattagcggcgcgttctcgggacaactcgcgaacgccgatgcaatgggacacggaggttaacgcgggttttagtgacgcggcgccatggctcacggtcaatcccaactatcgccaaatcaatgctaccgcagctttggctgatccggattcagtgtggtactattaccagcacttgattcaattacgacatcaataccccttagtgacgttaggttcgtttgagctcttgtgggctgatgatccgcaggtgttcttatatgcacggcaatgggaagggcggacctggctagtttgttgcaatttcacagccgagacactgtcccgaccactggatcaatatctgacgcccacggccaaatgcttgattagtaattatggcgagcagcagccaaataaattacggccttatgaggcttgggtctaccaactcgcataggtatccaggacttggctaattgaggcggtctttgaaatatacccaatcgttacgattagtgtgaattgggttgctcaaaattctgcgatggtcttaataagcgaccacctgactaaaaaactgctttcaaaaggataacttttgaaagcagtttttttagcgcacgacgaccacttgacccacgtgaggctcatctagtcgttggtgaccttgaatgaagcccgtgaggttaaacggtagttgttcatcgatcgtcgtggtcaattgaccagtatctagcaacttgaatagtaattgtaaggcggcttgatcagaaatcgcttcggtcggttggattgcttggaaacgaattgatttactggtggctggcaagtgacgggcaaatgaagcgatggtcgcatcaaatttggccattgctaagtcatctttgccaccaacgccatcgatagcgacattgattacgacgtcaccacggtcggctaacacgtgaactggattttgatgctgatagtcgacgaattggtcgactcccagtgtcgcaatcaagttagcataacggtcactagcaatcgcgataacgtgggcacctaatcgtttggctaactgaataattaacaagccgactgggctgccagcgcctttgacaatcaccgtttggtcggcctggatgtccgcaaagtagcgcaccgttttgtaagcgacaatccctggagtgactaagctgacggcggtgaccggatcaagattagttggcatggtcaccgctagatcgctatctaaacaaacctgatccgcgtaagtatggttcgtgcgggcagccaccactgtcccaacgtccaagtcagtgacagcggcgccaacttgaatgattttcccaatgacatcatgcccaggaatatgcggtagtgcgacgctttggatagtacctagccgttctaagcggtcttcctcggttaggttaacggctaaagttttgattaataattgattatctgttggaatcagctgtgattgtagtagttcttcaaatacggtaggtcccccaaatttttgatacccgtatgcaagcattgtaatccccctcctcatatctaagttcgttagttgacgtggtgccgggatgtgacttattagtaaataaatcatgcagtatcaattgacgaattgttagattgatccaaaacatgctcttgtctaattgtagccagcagtgggggcgaatcacaagcagtaacaattatattccgggattggttcggtcaccgattaaattaaacaatctagttttaaattaaccggcttcgttggctggctgatgcttcaggccccagccagtgaaaccactgataattgagaataccggtgatagtaagctgaagaaacaaaatggcaggtaagctaaggttgataccccgagcgtgttagcggcaaaggccccggcaacgccccacggaatcaggtaattgatgacagttccaccgtcttcaaggactcgactgagggctaagttagccaatcctcgctgattgaaggtcgttttgaacgctttaccaggcaagataacggaaaggtactgttcaccgacaaagatgttgacaccgattcccgctaaaatcgcagccgtaacagttgccccggcacctttcaatcgcttagttagcggcaccattgctgtctgaatgaggttgaatttcattagtaaaccgcctaacgacagggttaataggattaaggagaccgtgctcatcatggcactgataccgccacgtgagagtaaggcgtccaccccggcgttgccagttttggctacaaagccggtttcgatcatcgtggcgatcttagttaaggcaatatgaggttgctcgataaaaatcatgacgatggcaagaccgatattcatcaacaaggttgcaatggctggaattttaagtagggcacaggcaaacatgacgacgagtggcaaggccgcccaccagctgatggtaaagttattattgaggacggtcaacgtcgtttgaatcttgcccaaatggctttgtgttgcggctccggcacctaaaacggcgtagagtactagtgatacgacaaaagcaggaatcgtagaccacatcagattacgaatgtggtcgaataaatctgcttcggcaatggctgcggccaggttggtcgaatctgacaacggtgaagtcttatctccaaaaatggctcctgagatgatagctccggcaatcaaagctgggttgatgcccatcgttgtcccgattccaaagagggcaatcccaatcgttgagataatcgtgaaggcactcccgatggaagttccaataattgcacaaacgagaaaaacggatggaacgaaccactgcgcagagatcagatgaaacccaaagaccatcattgaaggaatgatgccagctgcaatccaaacgctgatgagtgccccgatgagtagaaaaataaaaattgggataatcccagttttaataccatcgatgatgccaccatgaatgtcatcccagtgggcaccgcgaattcgggcccataaaatgatgagggcgataacgagaataacgggggtctgtggtgacaggccgaacttaataacgccaagtcccataattgcaagcataatgagtaaaacgagtagggcttctggtaactgaactgaacgccatttctttgaattaggcataataattaactcctttgaggtcgttaaaccagcagtgaatagcccgacacggactgcttcaacagcggttgtacgccgataatagtgggtgaatataaaaaatcgtccctgttgcataataatgcaacagggacgattgattagaccgtggtaccacccagcttgagccacaatatgactccactcactagcagttaacggctctagttgttatccgccgggcgtacccggacctctcctaccgtatttcatcgagattaacctgatcggttcgcagcacccaccgacttcctgacgcacagttaattcgctacttgaaagtaagattatcgttcgttatttgaatataagcgataatagcatggcgtttttgattcgtcaactaagatatggctagaaacgtgttaggctaacaaataaatagcgataagtgggtacgctcaaatgaccgacaatggtagaatggttagtgttgtaagcggtgccttttatggttgaccgtgacaagttttttaaagcaaacttttttagggggataatcatatatggctaatcaatggtggcagtcagcggttgtttatcaggtttatccacggtcgtttcaggattcaaatggtgatggaatcggtgatttgccaggaattacacaacggttagattatattaaacagctcggcgcggatgtgatttggctcaacccaatttaccgttcacccggtgtcgataatggctatgatattagtgattattacgatattaatccagaattcgggacgatggctgattttgatcaattattaacaacggcccatgcgaaagggttaaaaatcatgatggacattgttgtcaaccattcatctgatcaaaataagtggtttacgacgagtgcgcaaagtaaggataatccgtacgcggactattatatttggcgtgatcctgttgatgggcatgaacctaacaactggggtggctttttcggtggctctgcttggaaatatgttgccagccgtgatcagtattacttacattcatttgcggttgaacagccagatttgaactgggataatccgcaactacggcaagcagtctatgacatgatgaatttctgggtcaataagggcgtggacggtttccgcttggatgtcattaacttgatttccaagcctgatagctttgcagacgggcagccagaagctggggaaccatacgcggcaatcggtggaattattgccaatggtccgcatctccatgaatacttacaagaaatgaatcagcaagtgtttgcaggccatcaactgatgacggtcggcgaaacgcctggggctacggttgctgatgctaagcaactggcaagcggccaaggtcaggaattaaacatggtgtttgaatttgaacacatgggcctggatggtaatccagatccggcgctaggtaagtggaatgaccagcccgtccgactggttgacctaaagcagagcttgtctaagtggcaaatgggcttacaagggacagcctggaatagtctctattggaataatcatgaccaaccgcgaattgtgtcacgattcggggatgaacggccagcttatcgggaacgttcagccaaaatgctagcgaccctattgcactttcttcaagggacatcctacatctacgaaggtgaggagctaggcatgacgaatgcccattttaccaagttaaccgactatcaagacttggaatcactgaatgcgtatcatcactttgttgatgacgaacaggtcgttcaacctgaacagatgttaggttatctcgcccatatgtcgcgggataatgcgcgtacaccgatgcagtgggatgatagtcagaatgctgggttttcaacggcaacaccgtggctagcggttaatgccaattatccgcggatcaacgcgcaactcgcgcaacgaacgcccggttcagttctgagctattatcagcggctgattaagctccggcaccatttaccagtcataacgacgggaacttatcacctattatcacctgatgatgcggccgtttatgcctatgtgcggcatatggggtcgcagcacctgctagtaatttgtaactttactgcggcaacccagacgcgacactttgcagaattacccgctgatgcgcatctgttgatcagtaactacgatgaagatcatcaagacgtattacgagcgtacgaagcgaaagtttaccagttttaggtcacaattagcttcgctgctggagtcgtgaatgtgatttttaacggcggttgtgtgattacgagcacgagttggtcgtgtaaatttaatcgtgatgacttaaccaaaaatgcgcccaataaaaatacccaacctatcattctagataagttgggtatttttattggagcgcatgtgtgattatgatcaagtttgtggttaagatttttgttcggcattgtcagccgcaaatgttttttcaataatgtcgataacctgtttgaccaaaccaattggaaattggtgggcccgacgaatcaagttgatatgcacgctaggaacctgaacgtcgtcgaacggaatctcaacgagaccatcgtcttcaccatcgttgggggtcgtgatgtcggaaatgaagcctagtgccaggttctctttaactaatcccttgatcaaggtgctgctatcagattcgaagagaacttggggttcaatcgaaagttgttcagcaagttgccggaagactagtttatttaagtaagttgcattaagcagtacaaaaggcgattttagcgcttctgcaaaagtcggatgctcagcctttgctaaggggtgcgcaacattagcgagaatgcgaaatttaaaaggccgtaatggcgttactgctagccgttcatccaatgtttgatccaagttaccactgatggctaagtcgagttggccggctaaaacctgtttgacgagttgattagcccccatttcaaccgtgtggacgctactaagcaaatcttgctcgatgattggttttgttaatgccggtaaataatgttcactgacggatggttcgataccaaaccgcagtgtatgttgacgcaaatgactgattgattcattgacatgctgccagttgttgataatgtcgttggctgcgagcaatagttgctggccactaggtgttaacaccagcgccttggtctttgcttggcgaaagaacagtgtcacttgaaaatgacgttctagtcgtttaattgcttgggagattgtgggttggctaacgtgaaaatcagcagccgtttgcgtataactctgagtgctgattaagcgttggaagtaatacaagtctttaatgttcatgaaaaatgtagcctccataaaatattaatgttggttgcgcaattaatagtcgcaggtaagcaggctccgactgattgattaaagctggttattatacgtcatgttaatcataccattgttataacgaatagtgtcaggataattagtgaaaattaatttacaaaatagttaacgcgcttaaactataatgattattaataagaatgttagtgctgattggtacagatgtagtgttgctggtaaattaagttttgagtcattatataattttatcagttaaagggctgccacatcgttttgattatcatgacgtgtcggttggtctgattaatcaccggaaaaaaagttgcattgcttaagtgggagtcgttagaaataaaggttaaagtgttaaagcgataagtaaacattatgcagattaaaaagcatacaagttaatgacaaactattagtaataaggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacaatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggtgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccataaagctataaaaaatacttatcagttaaggtgctgttatatatcgctcgataaatcaataattggtctacgtgtcatcggtagcgccagtctgccccgtttctcgacgtaattagttgacaagcaactaaagcagttaacgggtttaaattataaatgaaacgaatgacatcatttttactgattgcaattagttaaatctatattaatcagcataaattattttaattagctaacaactgtcacgaactcgtcaaaattgatggcatacaacttttgtataaaatattataatactaattatgattcatgtctttaaaatgttgatatatcggtaaattaattaagtgtacataaataaaaattatataggtgtaatgagccttttgaacaaatattgctggtatgtaactgctatctgtgagcgacgaattttgacaaaaagtgtcttcaaatttgcggaatgtggtttataattaagacgtgtaatcggtttaaaagttttaacttatataagaaaggggggatatcatgcgattaatcgatttcaaaacttggataatgggaacggccgccatgttgacattgattgtgacaaatcaaacagtgagtgcggcggacacagctaccactgccactgaaacgacgcagacttctggctcgagtacacttgctaatcaagtggtgttgcgacaaactacgagcagtagcagtagcagtagcagtagcagtagcagtagcagtagcagtagcagtagcacgaaagcatcggcaactggtgcggcgactgaaacggcgactagcaaagcggtcaccacgtctgagtcatcaacccaatcatctagcacaacggctactagccaaacgacttcaggtgtgacagccgctcaggcaacaacggacagtactgatacgacagcgacgtcccgggcgacggctaatgccaaagcggatcaacgagcggctagtgcgaaggcgaacaacgagcaagcaacgacccagaatcagcaacaaacgactaatatgtacagtggtgtcgttaccagtcaaaaagactcggcgagaacggcaactacgacggatcaagcaactgcgtctgtcgcgacactgtccagaatgagccgggccagtcttcgcagtttagcacaacgggcaacggttgcggttcaggggctcgatgctactgacgcaacggtgactgacgatgatggtgttacgtatagcgctacggatgtattgagtctgtatgcgaactatatcgcgaagtatcattggtcaatagccgatgatgttagcgtaactgctggcagtacagcaacggtgaccttacccgagaatgttgtctttaccaatggtacgcagcatattgatgtccaaaaatcagatggaacggtcgtcgggacttttacggccgagaccggtagtcaaaccggaacactaacttttaatgattattatgcgactagtgatcgttataatcgtcaaggagacttaacgttttatgttactgggactagcgcaaccactggcagtagtacgactgggattaataaggttggctgggccgatagtaatagtttagatgctgatggtaatcccaccaaaatgatctggcaagttgtcgcaaacattaatagtgaaaagtggcagcaagttgcgattgttgatcagctgggcctttatcaaacgcacgaaggtaccatgacgttggaaactggtcattatactgacggtgcctttgttaaagacgcggcactgggcacttatgattttgcaacgcagcagtttacctacgctgatggggtatcaacaccacaagtaaccgtgacggttgtgggtcagcagatgacaattaatattgaccaattagatgtagcggtcaatatattttatgaagttggtctgacagtaggacatacgtacaccaataatgcgggtgtaacgtatgcacctgtcattggagatgcgactgatccaaatgagggcagttcgacaggcgaaccaaagagtgaacaatcgaacgtggccgttagatttggtggttccggaaccgctagtgatgacattcagagttacagtttgttcattaataaaactgatggtgacggccagtcagttgctggtgccacttatcagttagaggatagtacgggtacggtacttcggaccgatttggtgactgattcagttggacagttacgcatcggtaacttgtcggctgggacgtacatgctggttgagacggcggctccgagtggctaccaaatcgacacggccaagcacgtcttcacggtatccgcagcgcaagcaacggctaacgtggtcacaggtagtgtggttgacaaacgaattgctaagacggcgctgactgttaacaaagtttgggctgacgtgccagctggagtgcaaacgccgaccgttgaagtgacgttgcaacgcaatggtcaagcttatcagaccttgcaattaacgtcagcaaatggctatacgggcactttcagtgatttggatgtgacggatgtttatggcaatgcgtacacttatacggtgattgaaacggccattgctggctatatcagtagtcaaacaactagtggtgagacggtgacattaacgaatacgtatcaaaccgggaaattgacggtgattaagacggattcgagtggcgccaatcgcttggccggggcggtttttgccgtgaaaaatgctgccggaacgctggttgctcagttgacaactgatgcgactggtcaagcacagcttacaggtctaacgcaaggcgcttatacggttagcgaaattcaagcaccggacggttacttgatcaatacacaggcgcaagtgcttgtgttgaatgagcaaagcgcttatcaaggccaattagtttttgccgatgaggtcgaaccaagtgaaccgagcgaaccaagcgagccgagcgaaccaagcgaaccgagtgaaccaagtgaaccaagtgaaccgagcgaaccgagcgaaccaagtgaaccaagtgaaccgagtgaaccaagtgaaccaagtgaaccaagcgaaccaagtgaaccaagcgaaccgagcgaaccaagtgaaccaagtggaccgagtgagccgagtgaaccaagtgaaccgagtgagccaagtgaaccgagcgaaccaagtgaaccaagtgaaccgagtgaaccgtgctaccaggacacgctgacgaggatagtgattcagatcaggttgtcacaacgaagactgagacagctaagttagtcaagcaaactaatttagtaaccacgactcggccaacgaaattgttaggacagccaataaaattagtagcaacttctaaaccagttgttaaagttacaaaagcaactaatcgcaagtcggcgcaacaattgccacagactagtgaacaatcaatggattggctaatgattttgggctggttcttgctagggctaacagttgttagtcgtcaacggcgatttaattaaacaaaaaggctactggaatttcgcttccagtagcctttatttatatcatagataagtgtcgccacattatcgacgattttgagatgtgcgttggtcatgcttaattctgactggttgggcagcgggaacacgggcgccagccacgacgccggcaacggcagctagtccggctgcggccaataaacctgctaataacatgggcaagacctcctcaatagttgtaaaaactcgtcttttaatacttgcagtttaggcgacttattaacaaaaatcaattatttaaccgtaaattagtgagaatctgaataacttgaaatattcttaagtaattgccggttattgttcattctggcaagggcggccgcatcatttaaatattcatgaatttgatccggttcatcggataattgagcctgtaagaatttgatccgcgctgcgtaataggtaacgtggaatcgcgcacaaatctcaatcccgtagtttaataactgcaaactccgcggtgtatcattaatgttagcgtaaaaagcccccgtgtaataagctaagttaatcacgcgccaaacactagcggtcgtttctagcggtaggttcggtagggcgtggcgtactttttcaaaatagtactgggctttatcgttatcctggttctgctgataagcaatcccgataccacagtaggccagctgtgtatagattgtgatgtgagcctcgtccaaatcggtgatgatttggtcaaaattaaagatgacatcactgatcgggtggtggttaagggcagcaacatagccttttagataacaatattgtaatttggtttcgcggtcatgtcgcggcatatccgcagccttttcaagttgtacttcggcatcttgatattcagttgtaatgaggtcgaactcgacctgttccaaaatcttcaaaacagcggcatcagcgacgcgttcggttggaaagacatcttccaattgtaggttgagtcgctgacaaagttgggcaacgattcgtatggcaggtgctttgccattgttctcgaacttacttagtgtcgcctgagtacaaataccatctgctagggccttttgtgaaagtcctagggctttgcggcgggcgatgaaaagctcaatgttcataccatcaacgcttcctttacatatttaagtcataattgaaacagctttcatttaccctaattaaaaactttttatataattttgtcaatatttaaacataatcttgcatattctaaaaatatatcttgactatataaaaaacgctcgctagtctttgctagtgagcgtctgtgagttatctgatggtttattttgccatataggcgtctttgaagttatagttggtaccagaagtgttataaatcaggccctttaacttagggttgaccatctgtgccagcgttgtttgagttaatggtgcaacgccttcatccgtcccaataattttttcagctttgcctagagcagtccagcgtactgtcggatcagttgattgctcggcctgcttgacagcagcgtcataatcagcatttttccacttaccaaagttgtaatcattcgtggaagtgagaatgcctaggtcagagatggggtcggcgaagtcagcttgccagccagaaatagcgagttggaaattacccgatgtttcacgtgcaagtcggtttttgaatggcaaggtaatatcggtaatcttcaaaccgggtagttccttttctagctgtccctgaacatattcggccgtctctttggtttggtcaatattatcgtgcgtaagcgttaaggttaatgactttttgccggtttcttttaatccttctgcccacagtttcttggccttagcggtgtcttgagttgtcgccgcactaactgcattttcagtagcgaaatcttcaccagtcgttggatcggttgcgagcccggtggtgacaaagccctttggaactgctgagccatccgctagtacgtccgtgacaagttggtgccggtcaatagttaaggacatcgcttgccggagcttggcattagctagcgcgggcacctttttctgattaaactcgaggtagttcagacgggatgtcttacggagcactaacttgggattattcttttcgtttttgacttgttcgccgctcagggtggccatgtcgagtttgttgctctggaataagttgaatccggtcgtggttgacttaacgacttggtcattgatcttttctaagtaaacgtgttttttatcccaatatttaggattgcggttcagggaccatgtcgtattagtgcctttccagcccttcatggtaaacggcccatcgtagaccatcttggtggccgttgtcccatagtccttgccgtatttctgtacggcgtgttggttctgcgggaagaagatggcaaagcccattaggagtttaaaataagccatgggtttatcaagtgtcacggttagcttgtatttaccgtcagctttaattcctaaactattggctttagctttaccattggtgatttggtcggcattcttgataccagaataaagataagcatattgcgaagcggtcttgggatcgatggttcgccgccaactataaacgaaatcttgagcggttacgggatcgccgttgctccacttggcgtctttgcgcaatgtgaacgtataagtttttttatctttggaaatgacagtatgggtcgcaatgcccggtgtgattttattattattgccaatacggtagaggccctccatcgtgttattgatcatattggcactgatcgaatcggtgactagcgaagtatccaaagtcgttagttcggagccattttctgaccagttcaagacttgcttttgtgccattcccgcgcgtaagttccccgcattatctgacttggactgaccttgactacaggcagctaacaaaaggccggtcgatgcggccgcagtagcagttgtcaacattactttccatttcatagtaaaacttccccccaacttgaatggtcacgagaatacattaaagcaagattaaaatcaatgttttgattctaacaattaaagtaattaacagccgcaaaatgtgtcaaggaacacaaaaaaagtaccgtagtttgttgctacgataccttttattgtgcgatttaagggtagtttgacgtgaggcgatgctagttaggtcaccttatttggccatataggcactcttgaagttatagttaatgcccgccgtgttgtagactaggcctttcagcttagggttgaccatttgtgcgatgacgttttgtgagagcggtgcgaccccttgatccgtcgccatcgtcttttcagcggttgcgagagcttgccaacgcttcgttgtactggttgtactatttgctgtgttgatagcactatcgaaagtcttgttggtccacttaccaaagttgtaatcgttagttgatgtcatgataccgaggtctgaaactggatcagcaaagtcggcttgccatgcggagatgaccagctggaaattacccgcaatttctcgggaaattctcgtcttataaggaacggtgacactttgcactttaagtcccggtaactccttttccaattgtccctgaacatattcagcgagggccttcatctgatctgtatcgtcatgagttaacgttaaggtaaccgacttcttgccggtttcttttagtccttgtttccagagctttttagctttggtggtgtcctgagtaacagctgatttaaccgtattttcggtggcaaagtccttaccagtcgttggatcagtagcaagtccggtcgtaacaaagccctttggagtgacggaaccatcgccgaggacatcgttgaccaactgcttacgattcaaagtcagtgacattgcttgacgaatcttcttattggcgagtaacttcaccttcttttgattgaattccaagtaatttagacgtgaagacttacggatgaccagtttgttattattcttttcgttcttgacttgttgtccagataacgttgccatgtcgagcttattactctggaagaggttaaaggctgtcgtcgtcgacttcacgacttggtctttgatcttagttaagtaaacgtgttttttatcccagtaattaggattgcgcttaagtgtccaggtcgagttggtccctttccaaccagtcatcttgaatggcccgttgtaaaccatcttgctggaactggtcccgtagtcctttccgtatttttccaccgcgtgctggttttgcgggaagaagaccacgaaacccatcaataatttgaaatactgcatgggcttttcaagtttgacggtcagcttatacttaccatcggccttgatgcccaaggtactagtcttggccttgccgctgacgattttgtcagcatttttgataccagaatataagtaggcgtattgggaagccgtcttcggattaactgtacgacgccagccatacacaaagtcttgtgcggtcacttgatcgccattactccatttggcatttttacgcagggtaaaagtataagtctttttatctttggacacggtcgttttagtggcaatacctggtgtgaccttactgtttttacctaatcgatacaaaccttcttgcgaattactgatcatcgtcccactgataacatcagtggctaaggacgggtcaagggtggtcaaatcctggccgttttccgaccaattgaggacttgagtcttggccattttggccgttgtgttgtcggcattgcttgaactggatgaggactgaccacagccgacgagtaaaacgccggtcgttgccgttaacgtggcaactgtggcaaataatttccattgcatatatgtaccccctgcttcaaatgattatgatatgtagatgagaatacattaaaattagattaaatacaatattatttttttaatcattaatattattaagcaaataaagccagtacgactcgttaagaatcgtactggcttaattaagaaaactaacgttgccattgcatcgtatattctggttgctgggttgcttggtcactagcctgatcaatgacacggaaaccgtgatagtgataaaaggcaatggctgggcgattagcaacatagacgtttaattgtaattgatgatggtcagcttgggcagtcgccaatagcgccgtccccagaccttgatgttgagcatcattgcaaatgaaaattccggcaatgtaatcgttttgtaagcctataaagcccagaatataagcttcaggtccgtcggtcagtccgacgatgagttcggctgattgtaatgcttcacgtactaagggggcttgttgacgccagtagtcggcactgacaaagtcatgggccgttaaattaccacttaaccagattgtcattaactgatcgagttggtgagttgtcgggtgttgtaagtgttcaatcttcattcgacactaccccgttttaatagtcgaacgcgactcactgccggaattttagacagttcagctattaggtcggcttgttgtggctgctgtaggtcgtcgacgtcaatgatggtgtaagcaatctggtgcttagcggcgttagccatggtagtgatgttgaggttggccgctgctagtttggccgtgatttgactcaccatgttaggcacattttcgtgaatgactgtaaagcggtaagccgcgttgaacgggacgtttaagtctggcagattgatggccgcatgaacgttaccggtttccaaataagtcatgatagtgcgcgcagcttgtgtggcaccgttgatttcagcctcgatagtcgagccgccgatatggggtgtcacggtaaccgcggattggttggcaagctggggttcgccaaaatcggtgtagtagtgggcaacttgtcccgtggctaacgcattcatgacggcagtattgtcaacgatgcccagccgtgaataattaaataattgaacgcctgttggcatggcggctaacgcatctttattaatcagatgaagtgtgtcggcatttttaggaacgtggacggtgacaaaatcagcttgtttgactgcatctggcagcgtggccgctcgctggacttgtttggcaatgttccaagcggcatctgcagatagataggggtcgtaaccaattacattcatgcctagactcaatgctgcattggcaacgagagcgccaacatggccgagtccgatgacggccaaggtcttacccgttaattcaataccattaaattgcgtcttgtcgtgttctgtgcgttgagaaatatcagcttctgtatgctgggccgaataggtcgttgcagctattagattacgggatgccataatgagcaggccgatgatgagttccttaacggcattagcgttacttcccggggtgttgaaaactgcagtcccgttggcggttgcctgatcgataggaatgttgttaacgccggcaccagcgcgcacaatgactttcaacgatgacggtaatgtctcggtatgtaggttgaccgagcgaattaagtaagcatccggatgctcagattgattgagcgtgtaatcagcagtaaacgtgttgaggccggctggggcgatggcgttataggttttaacttgatacataaatatcctccttgattaacgatggtgtgcttcaaaagcggctagatagtcaactaatgcctgaacaccggctaacggcatggcgttatagaggctggcacgcataccgccaactaagcggtgaccctttaggtttaataacccgtgctcacgggcgccttgaatgactgcggcatcgaggtcggcctgacctgtgacgaatggaacgttcatggtcgaacggtcgttggtcttgactggattagtaaatagttgtgactggtctaagaaatcatagagtaaggcggctttagcgtgattgcgagcagtcattgtgctgagcccgccttgggcctttagccacttgagtacgagacccgcggcgtaaatagcaaaaacaggcggcgtgttgaacatcgaatctttagccgcgaatagctggtaatccagcatgcttggcaggttggcgacttgaccaattaaatcatcacggacaatgacgattgtcaaaccagcgggacccagattcttctgagcaccagcaaagatgagcccaaaatcgctgacttggtaaggttcacctaaaaagtttgatgacatgtcggctaccagtggtacttgacccgtaactggcaggcgcgtcatcatggttccttcaatagtattattagttgtaagatgaatataatcgagggattgatcgatgggctggacgaccgttggcagttggttaaaatggttggcagcgctactccccagtatcgtgactttagtaccgacccgtttagcttcatcggcggcgcgttgtgcccagtgaccgctgtcaagcaacccgatacgatgatgaggcgccagatttagtggcgcagctgtgaactgtagcgtgcccccgccttgaaagaagagcacgtgatagttgtcaggaatggccattaaatcgcgaagatcttgttcggcatcttgaaggacttgcgcaaataaatcggagcgatgcgagatctctaaaatgctcatgccggagtctcgaaatgatggtagctccgcttgaatttgagtgatgactggttgtggtagaacggctggcccagcagaaaaattataaattggcatgaaaaatcctcgctttcagtagtttaatcaaggtaataaaaaagtcctcgcagtcggtttcgactaccaggacggataataacgagattaagcaattccacctggtagcgaatgtcttagcatccgtgctcaggctgatttgcgtacgcaaaattaggccgacacagatgggtgtgtagaccaggaggaactgatatgatgattgataggattagttagaaccatcagttggacactccttcgttaaactggtgttggcaccagttagttaattgcgttggtattaatttagcaagcacgtaactatttgtcaagctagataatgagaaaagactgtggcacaattagtattattaataataatttaatcttggaggcgcacgatgacaaccttttacgtggtacgacatggacaaacagtggccaacgcccaaaatttaaaacaaggcacgattaatacagccgtcacgcatttgaattcggttggcaagcagcaagcgcaaacgttgcacgatacgtttgacattagcttcgcggatcggttgatttgtagcccgcttgaccggacccaggccacggcggcgattttgaatcaaggccggcaactacctgttagccaggacgagcggttattggaaatttcatacggccagtgggatggacaggataatgatcagttgctagcggcctatccgcagtactttgatccacttttacaggacgttttgccaagctacgtggaggttgcgacggatggcgagacttttgagcacgtgcaacaacgggtagcagcatttttgaagacaacagcacaagcccatccagacgagcagatcattgtcgtgacccatggttttaccgtcaaagccatggccttagcgatactaaagccgaccgatccgatgagcttaccggagccagctaatacgagcgtcactaaagtaatggtggatgctgtccatggtcgccaatatttagcatattataaccgcctacctcaattctgacgcgcaatgacttaacgaacgggcgattccgggctacaatagatggtggtttgaaatagccacgcactgttgaaccttatttcaaatcaaagtctaattaggcagcaacagcagacatcacatataaactcctaagtgaggtggtcctagcatttggcgaggatcgcccttttgtatccgcttaagcgtttgatcagtaccaatattacaggcgcggtataatataaatagtattcaaaaattagatgaggtgagtaatgatgacatattcagcagcatcaacgcgctatgacgaattaccgattcgacgcgtgggtaagacggggctacagttacccgttgtctcgttagggctatggcgaaattttggggatgaagcgccgtttgccaattcacgaaaagtggttctagatgcctttgatcatggcgtttttagctttgatttagcaaataattatggaccatcgaagggatcggcagagcggacgttcggacaaattatgcaacgagatttaaagccgtatcgtgatgagctcgtcatcacgactaaagccggatatccggcctggtcagggccgtatggggctttcggctcacgcaaaacgttgatcagttcattggatcgtagtcttaagcaaatgcatttagattacgtcgacattttctactcacatcgtccagaccctaacatcgatttgtatgaaactgccgcggcccttgaccagttggttcgtcaggggaaggcgttgtatgtcggaatttcaaattatgaccgcgaccaaacggcaacgatggttaagtattttaatgagatgcacacgccgtttacggttaatcagtactcatataacatgttgaatcaacaggctcaaacaacgggcctgattgactatctcggccagcataatgcgggcttggtggcatatggtccattagctgaaggattattgacgcagcgctacttacaaggaattccagccgattttccgattcatcgaacgaataaatatttatttgatcaggggactgcagccgttgtcaatcagttgaatgccctgaacagaatcgctgagcaacggggacaaaccttggcccaaatggctttggcttggctactacggtcacaggtcgtcacgagcgtcatcattggtacgaccaatgtcgaccacttgcacgctaatcttgaagcaacgcacaatttaacctttagtgatgatgaagtaaaagctattaccgcgattctaaagtaaattgcattaaaggccactccccaatatgccggggagtggcctttttattagcgcgtcctgtttattaaggtcaaaaatagctcactcttaggctcgttaggtagactcctgttcttcagcaataatcgccctatttccgacctccggggcggagcgacaattgctggaacgtaaaccgacatcgatttgagcccgagcccgcccagtctcaaatacgagacttattctaagctggcggcttttgaatttaatgacggtcatgttttgaactgagccatagccgtgcgctaacttcaactgaccgaatccgggcaattttaaaataatttgggcgaatgttcggtaacctcggtagttaacggcataattagttagctggtgaaattactgattggtacaagtgaccggtttatcaacgtcatcaaaatgtaatagtttttatcgaacgtacgttctaaaaatgtgctatgatggagctactatttcgatgaggtgatctaatggaacagctgaaaccaattgaagcgtcgttattgcaagcttatgagttaaactgcgtggttcggttaactttaagtgatggtcatcagccgagtggcttaattgcggctgtggacgaccagcagctttttttgaatcaacaagcgggagtcgttaagccgattgcgttgagtgacgtaaccgccattgattttcttaaacagtcttggtggcagcggtaatcctaaaggtcgtatttcgctatgatttcgtgacgacggaattcggtaatagcagtaatcaattcaagtggtaggggctgatccagcggaaactggatggcccctttgcttgttttataggtgattaattgatcatgaaaagtctcaattgcacttggcgttgggtacaagccaaagtgatgtttgaataaagcaaaatggatgacgttttcgtgccaatagaaggtcggcatctggtactttaactgctcttgcgcctctggtaagaccgttgcaatggtttgctgtaaggctattaattgcgattgataggcttgtggtgtgttagcaatataggcctcaatcggcgtcatggtgaatatcctcttggtcacgtaattcagcggctaaagtagcatcagggacaacggtgatcgtgcgtgcaggaccactaaaggtgacaagcccagccttagcacccttgggtttacgcatctggccaacggtgagcacatcaacaggtacgcggttcatctgacgacccttactgtaataggccgtcagtacggccgcttcctgcaaggtttgttcactcggatgattactgtgaataaccacgtgtgaaccgggaatttcaccacccgcgtgcatccagtagtaatctttacgggccgtcaatgttaagtggtcgttttgacgactatttttaccaacttcaaccagcacgtggtcgtgcgtgtaaaagcggcggggatgggcgggtgttggggccttagacgagtgtaaaacgtgggtatgaatcgcgcccgcagcaatcagtgtttgcttaagcgcggcgaccgcttgtggatcattagggtcgaaagctgcttgagttgctaattgctggtatagttcggtcttggccgtcgtcaaattttgttgaacggtcgcttgaccgcgtttgcttttgtgataatgatgaaaataatcctcggcattttcaataattgattttttaatatcgagtttaatactgagttggtggccttgatagtcgggcaattcgacgaaatgatggtgcccttcgatctggctagcatacgtcttcaataacgtgcccttgagttgcaaatcactgacatcaggcaggtggtctaatgctttagttaatgattcgatttgtttacgcgtgtggtgaattaagtgcgctaatccagtttggactaggtcgacatcggttgtggtcgtcattaatgggttcctctaatctgtaaaagttaacgtcttaataataacatgttctggttagttaatagtggaagattgggactagcgaatgaattaagatgtcaaatgacacgattgaaaaaagttgagcaattttcagaaaagttcggtattctattacatgggagttgattgagaaatgcaaaaaacattaattattaacgcaggtagttcatcattgaaatggcaattatttgctatgcctgctgaaacggtggttgctagtggtctcgttgaacggattagtatgcccggttcaattttcaccatcaagtatggtgaccatcaaaagtttgaaacgacagtcgataatttagatcaaaatcatgcggcgcagatgttattggctgaattacagcgattagcaattattgactcattaacggaaattacggcagttgctcaccgagtcgttgcgggtggcgaaacgttcaagcaagcagttgaagtgacgccagcggtactcgaggccattaaggggcttagtgactttgcaccattgcataatccgatggaggcacgtggtattgagacgatggctcaggctttaccgaccgttaaacagtacgcggtatttgatagtcaattctttaccgatttaccagaaatgaatgcaatttacagtttgccatatgaattgacccaaaaataccatattcgccgttacggtgaacatggtatctcgcatggttacttaaccggtcgggctgcagaactgctggctaagccgaaagatgacctcaacctggtgacgttacacttaggtagtggcgcgtcattagctgccgtaaaaaatggccgggccttcgacacatcgatgggctttacgccattaacgggtgtcacaatgggaacgcgcgcgggtgacgttgatccggccgtattgccattcctcatgaaagctttaaagatcgatgatccgaatgaaatcatgatgatgcttaacaatcagtctgggttgttaggaatctcaggaatttcaccagatatgcgtgaaatccgtgcgcaagaagccacgaatccccaagcccaactagctgttgaaatttttgtcaatcggattgttaagtatgccggtagctatttgacagaattaaaacgggcggatgcgctgatttttgcgggcggcattggcgagcataatgcgaccttgcgccagcaaattattgatgaactgagcatctttggtgtgaccctggatccgaaattaaatgaagcgggtcaagaaggactcatcagtggcgcagattccaagattaaagtgatgttgatcccaactaacgaagaattagcgatggtgcgacaagttgcggcgttgcaaaattaagcttctcttaatttacgactgcaatcagtctgccgctgtatagcgcgtgctatactaactggcaaggtacccatgatgggacttgtaaggagggaagctctcttcgcagagcgcatagatgatcggtttattgattgctttagtaattggtttatggttgctcaaagttatctttaaaattggttttaaaattatcggttgggtgttcatgattgtgattgggttgtttttatttaaaatcgcattatggttaggcttgatcctcgtggcgattgccggcgttgcattattcggaaatgccaccacgtaatttgaaagataaagatgagcgttgttaaaactagtgtcatcggcacgctagccgtaaaggcggcttgttggaactaaatagtcattgaacaaaaacaggaaatctcagttagttttgtgagacttcctgttttttgagttagattaaagttccgagataaaccatgactaggccaccgacgagactcaagccaaagtattcccaggcgacccgttgatggtggttacggccgagcaacacgagttcgttgatcattgttgaaaaagtcgtatagccacccataatcccagttcctagaaaaatctgccagttgggcggtaatgagctggttaaaatccaaccgagcaataaagcgccggttagattgataaataacgtggcaattggtaacggccatcgattgagaggtagtgctaagcgcatgatgccgtaacgacttaaggcccctacagctgcgccggcaccggccaatccgactaggactaacattaaaattcctcctttggtagccaataggtgctaaggaagtttccagctagccccgctagcaaacccaaccctaagctagcagcgacataacttaaagctaaaacgctatgaccactttgaaacgattgtagcgtttcaaaagtgaaggtggaaaaagtagtaaagctaccaacgaacccgacgctcataccgataacaatatcttcagagacgggtaaccgcgctggtaacaagttagtaatcaggctaagaacaaatgctcccacaatattaatcagacacgttatccagaaatgctgtggccaagtgacgagcaaactaagcccctcccggagaccaccacctagcattgcgaagccggtaattgcaatgatctttttcaagctgacacctgctttctgaaagtaattttagtttactgaaaaaacttttaaaaaacaatggttcttgcaaattgaaattaaacatgctaatctacaaagtaacttataaaacacgaggtattcagccaatgcgcaactaattaattctagtaactgaacagagccatgcctagcgataggggtggactgtccgttttgggattaattagggtgctggtggaatcaattgccagcgttctcattttgaggacgtttttttgtgccataaattagtccctgcaactaaggggatgcttattaatgacaatgattaatttaaaaaatattcaaaaagatatggcgggacggccactatttacaattgaccgattagtcgccaatgccggggatcaaatcggcgtggttgggcggaacggtgctggtaaatcaacactggcccatttactgacgggtactgatcgtgattatacgggacaaattatggtggacgagccagtcagctatgttgcccaaatcgcaccgacttttgaccaaagtggtggtcaagctatgctaaccagaattcggcaggctttgagcgcccggccaacaattttaattctagatgaaccgtcatctaatttggatgaaacacatcagcaatggcttattaatcagttacaacgttttcgtgggttgctgttgttgatttcacatgatcggcaattattaaatgctgtgacgacacagacttgggcggttgaacaccaaaaattcaccgcatatgcaggcaattacgcatattatcagacggtaaaagcgcagcaaatcgcaactcaggaagccgcgtatcagcgccaaaacactcatcagcgtgagttactagcagcgcagcgtcaacgtaatgaaaaagcgcagcggattcgaaaaggcaatcggcgaatgtcgcaagtagagcgtgccaagacgaaagcgactagggaagctactgcggccaagatggaacgaacggctaaacgcatggtcgcccgaggacaacgggaaccgcaagttgctaagccctttacgacttcaggctttaagttagtcgcgacagattttccgacgtttacaggtaagaccgtggtaactggtcttaatgtcacattggctgaatatggaaaaacgttgttagcacacgctgaccttcaaatcaggccacatgatcgggtcgctatcgtggggcccaacggtagcggtaagaccacattactgcgtgcaattttaggtggccgggtgtcaggattacgattggctccggcggcacgagtcggagtattcaaccaagatatgacagtgctcgacggtaaacagtcagtgtggcaaacggtgcggcaagtcagtcagctaccggatcaaacgatccgtaacgtcatgggcgcgttgggcctgccagcacgcttttatccgcaactggtatcggcgttaagtggtggtgaactagttaaattacagctaattcgtattttagtcggtcaatataacgttttaatgttagatgaaccaaccaattatttggatgtggacgcgctggatgcgttggccgattacttacaaaattatcctggaaccgtaatttttgtttcacatgatgaaccgtttcgccaggccgttgctactcgggtgttgcaattcgagacgcaccaattagttgatcctgacaaagttgttaaagcgccgcaaccggtagaagctgacttagcagtacttcagttcaagtatgatcaattaatggcagacccgacgtcttctacagctgctattcaggcgttacggcaacaaattgatcggctgaaagcatgaattaaggtcaacttgttattgttgtgacccgacctaagtggggaatattacccaaaaacaggttttctcataattgagaaaacctgttttaatttagtgtttattcagtgaatgataccactagcgccacggaatgacgaaggcgccgacttgtaaaagcaagacgccactaatcacaatggtccaatccaacttagtcagtggaatctgacgatagtgagtgcggggtgcatcttcgacaaaaccatgggagcgcatggcctgggcaaggttctgcgaccaattgatagagaccaaaattgctttaaagtagagctgtggcgaccagaaggacaggacctgcccacgcatcagaccagcagcccgaatcacttgaacttcgtgctgaatccgtggtaccaagttatacgcggcgaggacgccatatgcaaatttggcgggtaaatgccagttttgctcaagcgaatcggttaattgtaagacgtcagtcgtgagcgtaaaagtagcgcccgtaaaaacaaacgcatagatccgtgtgaacaggacccaggccatcaaagtcttgtcaccgctaccgttaatgtactgggtactccaaagtccaattgctggtagcaacggaatgagtagcaaccaccctaatgttcgaagccgagttcggtgaccgagcaggtaaatcagtgccagaataatcagtgccacgttcaaacttacaattgtcgtgaatgaaatttctagcgcaatgatgagtagtaataataatttcatgctaggattcatgatcgcaccacccaatctaaatggtgattttcaaagtgtagctgatagtcaatcaatggcatcaggccggttaactggtgactaataataatcagcgtctgctcagttgccgcttgggtggtctgtaataacgcgaccagggcattgatcgaatgcaaatctagcccttttaagggttcatccatgagtagaactggtgactgcatgattaacatgagcagaatttgtagtttctttttctgtccctcactcaaagtatagatgacttgttcatcacgaccggataagttgagttgcactaaggccgtttgaatacggtctgcggtaaagtagtcgccacacgcatagcgtttactttgagccagttcttcagcgaccgtgatgtttaaaaactgggtctcagcgtcctgaaaaagcaaggcgacgtggcgagcatagcgtttgcgttttagcttgtcgataggtgtcccttcgtaacgaatttcgccagtataggggtgcagacggacgagggcttcaaataacgtggatttaccgctaccgttaggacccgtgatcagcgtattgtgttgtgctaacaattgacgcgttgtcggtactaatagttgacgatcacctgcctgtaaagtgacgtgatcaagttgaaaacaagggcgttcaacgcgttgcggtgctgaccatgaccgttgtggctgctcagtaaaggctgcaaataactcagaccaggtggtgcgatcaatgagctgtaagtgctggtccttgatttggacgacttgatcgacgagctgttcgtaacctgataggtcatgatccgccaagatgattgtcttcccatgttgattgcgtagttccacgagtcggtctaacaagacggctcgtgcggtcggatcgacactggcaaagggctcatctagtaggatgacatcgctatccatagcgacaatgattgcaagggccactttctgtttctcgccaccggataaatgatttaatagtcgtgactgtaaatttcggataccaacaaagtcaagcgcactaagtaagcgggccggtatttggtcacggggcacttgtaagttctcaagtgcgaaaattagttcattttcaacggtatccatggcaaactgctgattaggattctgaaacatcatggcaacgtgctgagcgcgctgattagcggtgctagcagttaatgactgaccatcaaaggtaatggtgccgtaatctggagtcaggggtagtaagcctgcaatcagctttaggagcgtcgacttacctgttcccgatggccctgtcaataggatgaagctttgccgtggtagtgttaggttaacgcgatccagaatgggtgtcgacgcctgtggataggtgtaagttaaattattcagcgcgatactagccattcgagaaagcctccattttataaagtgtattaatgcgttgattttaaaacatgactgcgatcaagtaggtccgtgatggttttagttaacagacccccgaaaacaaacatcgaaataaagcgaacgaccacgtataaaaccaagagccatagctgtaatttatagtaaccattacgggcaaggtcccagccaaaggtgaccacagtagttgttgcggccgcagccgttaagcctaaccagtcatagtgtttgtagccagtgacgatataacctagttcggccccaaatccttgcacgacaccagaaatcaatgtggtgattccccattgaccaccgaaaaacatttcgacggttgctgcgaggagctcacctagcgttgccgaaccctttagtcgaatgaggtagccagctaacatgccgggcatgcaccataagccaagtagtagttcattagccagaccgcttagaccaaatggtgtcagggccgcacttaaaatgttataaacaaaattagtccccataaagatggcaccaaagaaaataccaattagtgccagtaaaataatatcgttcaagtaccatgatttaacccatttcattgttaaatcctcccaaaagtagtttgtcattcacgcatccaagcgacaaaaaacgcctaccacgattatcggtggcaggcggctaagtctgaattgatggttccccaaataaaagcattgctccctgcgctggcattgtccagattcaggttcaatgggtattatctcagccgtgatggcaccccagttgctatgaatgatacgtttagtgtaacggataatgacattcagtgcaatcaattttccggaaactaaagcaaagtatgatgaaaagtcacaattttgtggtttactatggataaagcaatgtatttggttaatattcttaggagggatctcgatggcagaatcagtgtatgattttacagaaactgagatgagtggtgcgccacttgacttgtcacaatatcgcggtcaggtcttgctaatcgtgaatacggctagcaactgtggcctggcgccacagtttaaaggattagaagaactttatcagaagtatcagcaggagggcctagtggtcttgggattgccatccaatcaatttcatcaagaaaaggcggatgacgatgagacccatgactattgtcaacggcactacggggtaacgttccccatgaccaaacgggtgatggttaatggtgatgacgctgatccgttatttacttacctcaaacaggcggcgggacatggtcgaatcaagtggaatttcacaaaattcctgattggtcgtgatggccgtgtgctcgaacgctatgccccaacgacacggccggcaacatttgaagcagcgattcgtgatgccttggctgatcgttcagaagattaacgataaatttaacaatgatcgtttaatttaaaagaaagaagtggcttaagttggaaacttatacgttacgtgatggtttaacagtacctaaaattggctttggaacatataaactgaatggtgctcatggtgtgcaagtgatcgactcagcgattgatcgcggctaccgattattagatacggcctttaactatgaaaatgaaggtgctgttggtgaagcggttcggcgttcgtcagtaccgcgttcggaactcttgatttcatcaaaacttcctggtcgccaccacacctacacggaagctatcaatacgattcaagaatcattatatcgagctggcctggattattatgatttatatctaattcattggcctaaccctaaggaagatcattatgttgaagcttggcaggcactgattgatgcccagaagttaggcttgattcgttcgattggggtctcgaatttcttaccagaacatttagaacgattaaacaaagaaacgggtgttttacccgtcattaatcaggtcgaattacatccgtactttaaccagcaggcacaacgggattatgatcaagcacacggtattttgacgcaagattggagtccccttggccgggccagtgagatgcttcaaaatgagacgctcaaagagattgcagtgcactaccataaaaatgttggtcagttgattttacggtgggaactacagttagggaccttgccgattccaaagtcgtcaacgccgagccgtcaagcaggtaatatggacgtgtttgattttgaaatcagtgcagctgatatggcaacaattaatggtttgagccaagtggatggtcgcttgaataatcaagatccagcagtgtaccaagaattttaatttgaatgatataaaaagatagcgacgttgtgatgataactcgtcgctatctttttatgggcaactgcttgttgatgattggtttgtgatatcagcgtaatcgcaatgcatggtgcagtagcgattggcttttttaatcatacaaaatgctaactgtgtagctgtgagccactatctggtaaaatatgtttataggtatgttttaagggcgattggctgttttcatcttgaaaggtcgtggtagtatgacaaatacgtttcccacactaggaaaggttttcagccgtggtcactctacctgttcggtttgctttcttgcaaatcattttgagcatcgcactagcgatgtatcaggtatggaactccagaaacaaaaaatagccaccccaaaactttggccggtattgggtgactgttctttgattatctaaatttaaagccaactgctcttagagcgggccttgattcaagtcggtattaacgtaccggcttttttactgcctttattttaacacgtatgcgcttcagaaagtgtatttttgattcaaaaaaataaagataagcttccaatcgattggcataactattttattacgcgcgcttaaccgcgattaccttaacttgataagccccgttcggtgcgttcacagtgaccacatcgtcaacagtatgattagcgagcgcttgaccgatgggagatgtgaatgagattttttgttgttcgagattggcttcctgttttccaactaattgataggtgatttggtcatgatcatccagaaattcgatggtcacgaatttaccgatatcgagttgattgttgtcagctggttgaacgatttgggcgtattgcaactgcttgttgagataacgcaggcggctttctaagcgacctaagtcccgtttggcactactatattcggcattctcagaacggtcacctagtgccgcagccgcagccagaattctgattcgctcgggccgttgttgctttaagtcttcaatttcctgttcgatggcatggtaaccagtcgcagtcattttgttaaaagttggttccatagcaaaaacctcgtgtccgttgaatttctgggaatagtttaccgcaaatgtgattagaatggtaccgtctaggtgatatctgatgttaatcacgatcgcgcaggtggttgctatacagcatgataccgctagtgacggtggtcagggcgataccagcgatcagactaatgaacggctgatttatcgcaatcaggaagtagaatagggcggtgaaaccgattagttcaatgagtgcccacaggccaaggtagcgccatgaccgtttgggtttgtcttctattggggtgctgacattaacagacaaaatgatcatggtaaaaacggcaatcatcaggacaatatacaacggattgtcgtacgtaaaggctttctgaagattgtttttttgccagccttgccaaaataaaatcagtaagatagcactattttcaattaacaacgtggtacggatgttcttgaaattttgtaaaattaaacgttcgtcacgaatctttttcatggcagggatctcctaactgggttcgacccaaaagacagtatcgagtgtttggttgagtacgtgacagaggttgaggcagagtttcagtgatgggttataggtgcccttttcaatcaaactcagggtttgacgggtgatgccagtcttgctggcgagttctttttgtgagaagccggccattaaccggtattgcttgacatgattcgcggttaacacctccctttatgtaatatatatcttccatacaaagctaattttagccgttaccaattgcaatgtaaatattggatagtttgattgaaatgtgaacaaataaatggttggcgtagaggtatgagcgcaaaaaaatagccaatgactttgcagccttggctagtcgtggaatttctcacgttccacggagttacgaacatgttaagtataggcaaaattatcgaaaaatacaattaatttattaaaggagtttggcttgacagtttaacaatgataacgattgcaaaaaataaaagtgaaatatttcagacaaacctcttgaattttagtctagaccaatatacaattggactataccaaacaaagagggagtcagttaattatgaaagttatcgtagtaaaggatcaagctgccggcggaaaagaaggtttcaaagtatttaagaatgctttagacaatggtgcgaaagtatttgggttggcaactggttcgacacccgttacaacttacaaagaaatcgttaatagtgacttagatttcagtgactgcacatccgttaacttggatgaatacgttgggattgcaccagacaacgaccaaagttataaatacttcatgcaaactcatttattcaatgacaagccatttaaggaatcattcttgccaaacggtttagcttcagatccagaagctgaagttaagcgttacgacaaagtgattgacgaacacccaattgacttacaaatcttagggattggccgtaatggtcacattggttttaacgaaccaggtactcctcgcgatattacgacgcacgtggttgatttaactgaatcaacgattgaagctaacgcgcggttcttcgccagcgaaaatgatgttcctaagcaagccttctcaatgggcttagcttccatcatgaagagcaagcacttattgctcgaagcattcggcgaaaacaaggctgatgcggtcaagggtatgattgaaggcccagacacccctgaattaccagcaagtatcttgcaaaaccatccagacgttaccgttatcattgacgaagcggctgctagcaagttaagcaagaagtattaattttaattaagttaaaaatgaactgaaagccgtgcttcataacgattgcgttgtgaagcacggctttttaataagtactcatgtaaagtaaaaaatgattcgactactaggatagttagcagttgaatcatttttggcttattcatagattttgtcctttttcccaagtcgttttcgataacaacagcccttgcttaaccaaagtatcaaacaacgcatgggtccggttggaaatttcggcggcggtttcgctattggctttggtcaagaaatcggtcggattgccggtaatggctgcgtcggttgcggcaacccggccacgggcatatgattggcacccgtcgcgataggcattgaccgtttcagaaaattcatgccagtgtggttcaatcaagacggagagcgtttttgataaccagtagacgttatcaacgctgaccgtgctagttgtattgcgataatcaatcggcgtgtcattgatgttggtaaagaagggcacgtatggggcgtaagcgaagaaacctagtgcgatccattgaatggcggcttgcttagcaggcacgtcattccggatttgcagaatagatgagcactgattgcgatccatcgcgatagaccggtaacgtgtttgttcacgggcgttaccagaagcgaaagtgccaaatggatcgtaaggcgtcccgttatagtgtgaagataagaagaactggacgtcttcaatagccaattttttgcttggttgtcggaatagcggcatgttttgatcagtgggattctgttcgatttcgggattaaatagtttttgaccataccatgttcgcggagtgttgtaataagcatccgcctcactttgggtaccaaagatttcacggaaattaaagtgaccgggtgttgggttgaggtgatacttttcaacgaagtccactaaatcactggcacctaggaaattgtcggtatcgttgagatccatctcttgcaccacggtttggttgggaacaattgcgtaggtgtcttcgggcatccgaactgccccccaatggtgaccaccagcggtttcgaacaaccagatatcgtcgtgatcgttaaaggcgatactgttgctttcaccagttccgtatttttcaattagggcacctaagcgttggacaccttccttagcacttttaatgtagggtaaaacgagggtgaccatggcttcttcatctacgccatcatggacgagcggatcataaccgagtacgcgggcattggtggcagtggtttcagttgcgctcatcccgacatttaattcgttgatcccagcttcctcgtactgcccatcgctttgatcggcttggggggttgcggtgtagcggtaggcatggtcaggcagcggaacggtgacgccggtagttacggaagtgtagctggcgttagtttggtcgtgggcttcgtgcacaataaacttaatcggattaattgggccgtagccatcttcgttgcgggcaacgatggtcgaaccatccatgctagcagctttcccaaccaatatttcggtacaatcagtgtcttttttcattacataggtcactccttagttaattataagtataggagcttgcggggggatttcaacgttaaatcgtattcgtaatcatttaaataataaaatgatgagagaattgccaggtgttttctgcataaaatgttgaatttgattgtgaaaattaaatcatagctgacgaaaaaagtttaattagtctgctggtattgccgatataaaagtttttatcgatactgtgccaaattttaactttgtgaattagtgagtttaattgtggcacagtttcctgtgccacgggtctaactagaagttcttgaaaccgcttaccctgatggatatgattaagttgttaagaaaaaggaaggagctttacctaatgagtgaaaatgtaaatacgaatgcaacccaaagcgctcctgttgcgaaaaagaaactgggcgttaaggcacgcgttcaaaaatttgggagtgcactaagtaatatggttatgccgaacatcggcgccttcattgcttggggcttaattaccgccatctttatggctggtggttggtggcctaatgctggattagctaagatgattcaaccaatggtccattatttattgccattattgatagcgtttactggtgggactttgtttgccggtcatcgtggtggggtcgttggtgcgattgccactatgggggtcatcgtcggttcttcaatcccagtgtttatcggtgccatgattatggggcctttaggcggttggtgcattaagaagtgggatgacgccatttccgataagattaagagcgggtttgaaatgttggttaacaacttctccgctgggattatcgggatgttactagcaatcttgggttactttgcaatcggtccattggttgctggtgccagtgctgctatggctgccggtgttgactggatcattaagatgaagctattaccattagccaacgtcttcatcgaaccagccaagattttattcttaaacaatgcgattaaccaaggtattttaacaccgcttggaattcaggctgcatctagtgcgggtaagtcaattctgttcttgctcgaaccagatccaggtccaggtcttggggtcttattagcctttgccttgtttggtaaagggactgctaaggcttctgcacctagtgcgattattattcattttcttggtgggattcatgaaatttacttcccatacgtattaatgaagccagcattgttcctagctgttatcgctggtggggttactgggacggccacattcagtttactaaacgttggtttacgttcaacaccttcacctggttccattatttcactactattaatgtcaccaaagagtatttctaactacattggtttaattatcggggtaacgttagcaaccttagcatcatttatcgttgccgcaattgtcttgaaacgtgacaagtcgaccggtgatgatgacttagccgctgctcaaggtaaaatgagcgatatgaagagtggcaatgctgaagctgctagtgcgactgacgctgaaccagctgatgtgattgcttcatacaaagatgttgaccatattatttttgcctgtgatgccggaatgggatcatccgcaatgggggcttccttattacgggataaagtcaagaaggctggcattagcatgtccgtcaccaacacggcgattagcaatttgaaagacgaacctggtttattagtgattacgcaaaacgaattagctgatcgggcggctcaaaaagcaccacacgccttacggttagccgttgacaacttcttgagtagtccaaagtatgaccaagttgtggttaacttaaaggctcgtgatcaagttagcgatgctgcacctgcatccgcagcaccacaagcaacgacggctgcacccgacgacctaccagctaacttagatttgagtgttgttgatgaaattgtctttgttcaccacgatggtcatttaggaacagccacaatggcaacgtccttgatgaaggatcgggtcaagaaagccaacaagcatgtgagtgttaagaacttaggaattgacgaattggctgataataatagtttattagttgtttcaagtgcagaagcagctaaaaacttaaagacccgttacacgcaggtccaagtattaattactgacgatctattgagttcacctaaatatgataagatggtatcagaattgaaataaaatgatattattaccattatcgtatgaggtggcatcatggttaagtttacacaacgtcaagatgagttgctacagctgctactagcgaatcccgccggcctttcaatgagtcagattgaaaccggtctcaatagtagtcgccgaacaatttatcgcgagttcagtaatttggaattggtattagccaatgctgatttgaaaattgttaatgagaagcatcactttcaactaagtggatcacagacggccctggccaagtttcaaagccaattgacagcagagcggaagattgcaccggcgtttgactcacaaacgcggcaaaacgccctagcttgtcggttactgatgacgggccattccgtaaaattaaaagaacttgcgcttgactttgatgtgagcgttgcaacgatttcaaacgatttgacggcattagcaacgccattcgccgactacgacttatcaattgaacggttgaagtcccgggggattcaggtggcggggactgagggtagtattcgcaatctgtttgccaccattttgaataatgaaatcaacgactacgagttttttaaaacaatcgggaagttgaaccaaggcttagcaatatcagcaagtgatgagcaatcgtattttttgaacttactggacgcccaaacgttgattatctgttatcaagcagtgcgaagtttgaagaaaaagtacttttcttcggtgccggatggtcagctacaacagttgatcatcacgttgacgacgggagtaatgcggttacagcatgaacgtcgggtcacatatttgcgcgggatcaatcgggatgatttcttgaaatatcaacggattgctctggcaattatgacccaactacccgctgagattaagacggtggtgacgggagctgaaattgattttctcgcccagcaaattaagggcttgacgtttcgaatcgatcaagacgcgtcgctatcgaattatgatttgcaactaacgtatcgggtcaaaaagtttattgacgcggttgcgactaactttaactggtcgtttgggacggatgaccgcttgttgaataacttgacggcacatatgcaaattgccctacaacgtaacggtgttaatggtcccgtgccgccaaccactgagttacaagaggtccgtgaacagtatcctaagctgtattcggcggtggtgcgcggcttcgcaacgatttttaaagaccaggattttacaactgatgagttgacgtacttgttgattcactttgctagtacgtatgagcaacagttgagtcaccaagcactcaaggttttggtcctgtgcccgaatgggatgacgacggcgcgaattttgaaaacgcgactgatgcggttagtacctgaaatcacggctatcgaggttgcgcggattggtaatttaggccaagttaatttacaagactttgacatgattttatccacgacaacgttaccgggatttaagttgaattaccgcgttgtcagcccactgttactagaaaacgaagtcactgccttacgggaatatattcatcagtattttccaagcaccaaagtgatcgattcaccggttgatgagccgacgaaaatcaacttggattttgacaccgtttaccaacagatgacgattgctaaacagatcttagaccgtttcactatcacgccgattcgcaacgatgatgagacggtggccgagatgctagttaagatcacgcggcatattgattcgaacttgattcatgatccgctagaagttgcgggccggttgttacaccgcttaggactggcgccggtcggtattcccaatacgaacttggcgttggtgcatacgttaagtcaggaagtcactgcaccatattgtgcgattttcgaacttgaccagccattaccatttaagagtatggacaaccaatcgattcggttgcagcgaatcgtcctaatgctcgggcccgccaatatcagcgattttgaaaatcggttgatgggtaagttaagcgcactagtcattgaaagtcaggccaatacgcagacgtttatgactggcgatcgccagcaactttatcaattaattagtaaagcatttttgaacgaactaacgaaatagcgtaggtgaaaacaatggaagctttagataagaaaatgattgcgttgaaccagcaagtggctacgcaagaagaaggcatccgcttagccggtcaactattggtcgatggcggttgtgtcgaaccagaatacattgatgcaatgcaggctcgtaatcaggatgtctccgtatatatgggtaatttcattgccatcccccatggtactgaagatggcatgaagtatattaaaaagaccgggatttccgtggtccaagtaccaatgggtgtgagctggggtaatccagatgataacgatgatgataagactgtaacggttatcttcgggatcgctgggttgaacggtgaacacttgaacctcttgtctcagattgccatatactgcagcgacgttgccaacgttgctaagttagcggacgctcaatctgaagatgaaatcataaatctattaaaggaagttgattagcatgttagacgtacattttggtgcagggaatattggtcggggcttcattggcgaaaccttggctgacaacgggtttaagattactttcgttgatgttaacgatactttgattgacgaattaaacaaacggaatggttataccattgaattggctgcagaaggtcaaaaacatattgaagttcacgatgttaagggtattaacaacggtaaggatcctaaggcggttgctgaagaaattgcccaagccgatatggttacgactgcgattggacctaagatcttgaagttcatcgcgccattaattgctgacgggttaaagttacggcaagctaacaacaatacgacaccaattgatatcattgcttgtgaaaacatgattggcgggagtcagtcattaaagaaatccgtttatgaatcattaaatgaagacgaacaagcttgggctgaccaaaatgcgggcttccctaatgccgctgttgaccggatcgtaccgcttcaaaagcatgatgatccattgttcgtttcagttgaaccattcaaggaatgggttatcgacaagtcccagatgaaaaaccctaagattcaattaaagggtgttgattatgctgacgacttggaaccatacattgaacggaaactcttctccgttaatactggtcatgccaccgtagcctatactggtaacatgaagggctacaagacgattggcgaagcggtcaaggatgacagtgttgttgaccaagctaagcacgttttaggtgaaaccggcgacttgttgattcaaaagtggggctttgatcctgaagtacaccatgcttatcaaaagaagattttgagtcggtttgaaaacccatatatctctgatgatattgaacgggtcggccggacaccaattcggaaattaggtttcaacgaacgtttcattcgcccaattcgggaattgaaggaacgtggtcgcgattacagcgccttagttgatacagttggtgaaatgttcttcttcaactatcctaatgatagtgaaagtgttaagttacaacaattattgaaggatgaaccaatcgaacaagtcattcgcgaaacaactgacttgaaagatgaagatttagttaatgaaatcaaagctgcgtacgaaaagcacttagctgcaacaaagtagttcgataaaaaaactaattactaaccgccatggtaattagctgcaaaaggcgcccagaaatttaattctgggcgccttttgcgtcttgcctgacaaagaaccacttgatagcagccatcgctgggcgagttaactggaacgatgaacgtgtaggtagcttatttttaagactggcagcacacgttaatttggatggtaggtaatgctaactgttgccctaccgaagtaagtctaatgagcaagtatgttgaccagcatacggctacttttcccagaaatgccaccaaggtttggccgcttgactggcttgttgatcaagttggtcaaggacttggtttaagcggtcactgagtgaatctaagcgccggatgatcatttcttgctgcttatagagctcagcattagtcgggccatctggcttggccgctggtgccattttgttgggatcgacggtggttgtcgtgatgaggggcgacttggtggtagttgcaggcgctgatttctcagactgagtcgtcgttgccgccggttgtttggatgtcgggaccttagcaccaaacgcccgtcctagcgcagtggctaacgttgtgccctgttcggcgagttcgatggccgcctgaaaagtttttaaatcagcggctgtatataagcgatgactgttatcggccgggcggaagcgattttcatcgttaagctgtttttcaaccatggtgctatatttgcgcaacgtcacggctttaataccgagttgttcagcggcgacggaagcgactaattcggagtcctgttcgggactgattgtttgtgtggacacaaaaattcctcctttaggttatatcgtttctataacgctattatatcgaatttttgattggtagaacaccgatataccaagattttgtgacctatgtacgtgattcagacccggaagtcataattttgtgggaaaacatgctatgatagaacggaaatcaattggaaatgaggattagatatgatcgaaccagtcgataagacgacttttgcgacggtggctgatggtaccgcgttaactgtggttgatttttgggcggattggtgtggcccttgcaagatgcaggaaccagtgcttgaagcgttagatgaactgtacgatgggcaagtgaaatttgcttcgctcgacgttgatcaacatcaggaaattgcgcaacaatttgagattatgagtattccggcgttagtgatattcaagaatggccagcccgctgaaaaggtggttggttttcatccccaagcagcattgaagaaatatctggatcaaaaactagccgaagtgaagcctgcctaacgagcgttatttaacggtagctgttgaagcaatcaataagtccctccagaaacggttaccgcatctgggggacttatttttcttggtgagtaatttacgcgttatgacgtaattgataagctgcccatgtgctgaaaatggcaatgtcaagaattgcgaggttaatgagaatcgtttctgtcagtggctgggttgatggggagaaataccattgttctagtaaaaaagtgtacaaaaacacgggtgcgtagaagaggcggagccatcgttgctggcggtgtaaccacaccagcgtaattcccgacaaccatatcagtactgatataacaaccgttgtcagtggactaactagcatcgtcagtgtggcgattatggctagcagatagggtgttgtcataagtgggttcttgaatgagttcatcagtagtgcctccttattgaaaaagttaatgctcgcctaagtatatcgcgataatcaaaatatttgtattgccatcataaaataaaatatttaaatagtgattttgacaataaatcagtttagttgtcaagttagaaatcgttaatagtttaaggggaagagcaactagaaatggcgagttggtgcgactgccctattaataattaaattattaccggctttgccaatataattagctaagaccatgttaaattaagtagcgtaattatggtaaagtggggggctaatcattgaaaaaattgatttgggcattacgggtcggtatcgtcctctttggtgcttgtttggtgtgggaacaagtgcagcttgaacggcatacaagccagcgccggacctatcatcaacgtcggctgcagcgtagtaccgcagcaacgtttaaggcaatccgtcagccacaacttagtgattttccggcagctaaggtggaagccgcacaagtttggctacacctgaaggggactcgggtcatcaacgaggcaaccccgttacatatccgcaaaattgcggccggacagcgaattcagccagacgatccgcacagcgcggtctatcatcaccaaatgacccagatttatagtgatgatttacaagatgctactaatagtgtgatatacgcgcggaatgcggataataccgtattggttgcgcatagtcgttcggggcaacgctcgcaagtgggtccggtcgcccaaaatgttcacacagcaatgccagccgttcaaaagatgaagattccggctaaaccatccgcgacactgcttaaagtcgttcaactgatcatttaatatggggcaatttaaaaggctaacccacacggtgggttagcctttggtgcgtgatgctggccagctaatagtggtcatagagttgctcaattaagtcatcactattggtaatgagctggcgatttagtgaaatcagatagtctggttgtgctgggtgaacggcgttgtagagcgtgtcttcaatgagacagccagtcagcgtgaacgaccgctgccgaccttgaacaatgatggtgaaggaacgtccacgactagttacgatgacattcaatcccattaagtgggttaggttcaaacccaacgttgcagttgaatcaattaatcctggtgtgccagtacgtttaatcaagactaggcattcatcaatccgtcgtagcgaattaaacatcgaaaatttactggtgttgcgcgggtccgatttgacagcccgcggccgccgtacatatggtccaacgactatgttcataatgattcccccaaaccatttagttgattggtttaatcataactagtgcgaacgattagtgcgaaaatttcggcgcgtgttggcagttagttgggccagtttacgggttatctttggaagctttactaacgttgtgacggaaaacatccagtgtatacaaattcgcaattactggacgcaatggcgttcagaccattgatcagtaattgcgaattgcgtaatcgtgatgttaaaaatgaagctaggcttttactttgttgtctgcttttcgtgctttaacggctaattcggggaaccaaattgcaatttcgtgatgcgcattttcacggctatctgaggtatggataacatttcgtaaaataccgtctggatattcatgagagaaatccccccgaattgtgccaggttgtgcttcggcaggccgggtgctaccagctaaacgatgcaccgctttgacgacgccagtaccacttacgataatggcgacgagtggaccttccatcatgtaggtctcgatttccttaaagtaaggcttaccaaccttctcactgtaatgttgttgaagttgctccgcggttgctttaataacctttaaggcggcaatttgataacccttgcgttctaaccgggtgataacctcaccaatgtgtccttcactgacaccatcgggtttaactaggaccaatgttttttcagaatttgccataatacgtgacctcctcgctttttgaaagcggtatcatttataacttaaattgtaggtgactttgaggggtacgtcaactagaatcgccgttttatcatgaaaattgcttgtaaattggcgtcagctggtcaataattgggacgcgagaagcgggctcaactagctgaattattttctatcgttggaagatatcgctataataaaattagtaaatcataaaaggatttgatactcatgccaccacttgatttaactcatattcgacaacatcatacggttgctgaattaattgcgctaggaaaggcgcggcgccaagtcaccccatttgaaaaattagggacatttacaccggtgaagcgaaacgccagtgattatctgaaacatgtgcgggagatgctggtaccagaactattaccattgcggcgtgaacgaatgtccgcttcggcttttgcattcttccggggatcagttgagttaatggattacgatttggattaccagtcgtccactgaaattcccgccgtagtttgtggcgatgctcatattggtaactttggattctatgcgtcaccagaacggcgactggtatttgacttaaatgactttgacgaagctggcgtccatccgtgggaatgggatttacgtcggttattagttagtgtgttgctagctgctcgtgattctaactttaaaccaaaaaaggtcgaaaaattgatacaggcggcgagtgcgagttatcgggaagcactcaaacggatgtttgatcagacgacgttagaccgtttttatcgcgataacgaagttcaggctgtcttgaacttcggtggtgctcccgaagatacggccgatttaattgcatccttggttaaaaaggctcaaaaacgtaattcagaacaagttgtgcgtaagtttacggtcactaatagtcgcggtgaacggcaatttaaggagaacgcgccccgttctgtccatattgatcggcaaacttatcaagggctaaaggccggaattagcgagtatttattgaacgtacggaccgatgtcgctttgctgttgtcgcaatatgaagttactgatattattcggcatagtgtgggcgtcgggagttttgggtcactatgttacttggttcttctgacgagtacggatggtagccatatggtgttacaaatcaaggaagctttaccaacgcggaaagtcgggagccagtcgcggccagcgttaacggccgccatggaattgacggaagggcaacggatcgtcagttcgcaacgcattttacaagcaacctcggatgcgttcctgggctatttccaaatggaaaataagagtttttatgtccgtcaatttcgggatatgaaggaatccattgatattccaaccctagactggggtcaattccaagcctatgcaaatacgtgcgcaatgattttggcaaaggctcacgcgcaaagtccaacggcggccatgattcggggatacgttggaaattcggcgaagtttgatgaagccatggctaaatgggccacggcgtatgttgaacaagttgataatgattatcaagatttcttagatgtttgatggttttaaacgaagggttgatcaaatatcgcgctgaaatgcgtgacgattagacgtgtattgaaaataaagaaagggtcatcggaatcattgatactccgatgaccttttctgtcggtaattagacatagactaaaatatttttctggagcgtaagtcttgatttaacaacgttttttggcgattgaacaagtgattttgaaaattgataggctaaaatggttgcactttttcaacaacttgatatacttactattagtaagtgaaacgaagaaattagttttgaaaggattgtttgatatgacaaaatatggtgtaattgtaggttctattcgtaaaaattcttattctaaaggggtcgctgaagccatcgttgctgggttaccagacgacgctgaagtaacgtacttaaatatcgctaagttgccactatataaccaagactacgatgcggattcacccgtagaatatacagaatttcgtcaggccgttgcggctcaagatgcgttcatctttgtcacacctgaacataaccgtagcatcccagcagccttgaagaatgctttggacgttgcttcacgtccatggggtcaaagtgtttggggcggcaagcctgctttggttgcttcccaatcgatctctggtatctctggcgtcttagcacaccatgttttacgtcaatctttggtcttcttagacatgccaacgatgcaacaaccagaattgtacatcggtaatactgataagttagctgatgaaaatggtcatatcacaaatgaaggcacccaatcattcttagctggtgctggtaagcaattcagcgaatttgcagcgaagtttattggctaaataagtcgttaaatatttatgaataaggtctatcagtgaaagcacgtttagccactgataggccttattttttattaagactttgtgcgtggcactcaaaaaaattatttacgcgcgttttataattaagttagccacccagccaaaatggtaaaaaaaagacaccaagacgaaaaattcaggtatcattgaagttcctacaacaaacaatgaaagaagttttcgtcttgctgcaagaacagtctatcacaccacgcccaaaaggtcaccatttatcggaaatcgaacgcggtcaaatcgccgcttggcacattgaaggatgctcagcacggcaaatagcgattcgattaggcgtctgccaccagaccgtcaataatgagctcaagcgtggtcgagtcacgcaagttaaacgcgttaataatcagaaacactactttgaaatttacagccctgaagccgctcagaatcgctatgaaataaagcggcaaaactgtggacgtccattaaaatttagccaagtgacggccttcttagcctactttgatgataagttctgccatgagggctggtcgccggacgctgctgttggttatgcccgtaagcaccggttatttaagccggccaaaatggtctgtacgaagactttgtacaactatatcgatgcgcaactgttggagatccgtaaccttgatctgctggaaaaaacaaaacgccggacgacccaacaccactcgcaccaacatcagcgcctactcggtcgtagtattgaagaacggccaaagcgagtagaaacgcgccacgagtttggtcattttgagatcgatactgtcattggcaaacgtgctggtagcgagagtgtcctattaacgtttaccgaacgtaaaacgcgctatgagattgtccgcttgatcgagggtaaagacgctgaatctgtggcttatgccatgcaaaatattacggctgaattcggtgacgttatgcggacagttacggcggataacggaacagagttcaccacgctaacggctgcgcttgagggtattgccgagacttattatgcccacccttatagctcggccgaacgcgccactaatgaggtccacaatcgtatactcagacgttactttcctaaggggcaatcactcgatctagctacacccagtctggtccgtcaagctgaatctcggctcaaccatctcccgcgccgcttacttaagttctgtacaccagctgaagtatttcgaaaggaattagcacgtgcgcgcaaaggccgagccgcctaatcctgatccacctggaactcccatgagccctttcgtctgtgtgctttatcggtactggctaacttactattgcaatttgcgaaaaaattatttaaattatttatacaaataattatgaagtgctgacagagtctgacggccaaacttgattgttaagtccgcttaataaaccgattttgacagttttgtaatctggtgttttagatcgaaatgtaatagagttatattaataatttatgtacgtgaaaggtaacgatagcatgggaacaaaaattctatatcaaaaagttgccgcagatcttaaacgacggattctagatggtgactatgaagtaggtggcttaattccaagtgaaggggaacttgaacgttactatcaagtcagcaagattaccattcgcaaggcggtcgaagttttggtcagtgagggctacttggagaagaagagtggtattggcacgcgcgttattagtaacgatctatttaacaagttgacgcagacgcagtcgtttacggcaacggtcggccagcaaggaaagttgaccaaagagttgataaaaattgaacgcgtgccagctgtccctgcattgctacccagcgagtctcaagggacgatgttacgtattaagcgccgttatttattagatggaaaaccatttgcggttgtcgatcattatttaccgaatactttggttcctactaaactaacggcccttcggcatcgttcactgtataagattttacaggagaatggtcagacgattacacattttcaagataaattcagggctgtcactctggctgatagtgagcgggcgttgcttgaaagtcaaacgccattagcgattcggcgcgaacgtaaggggtatgatggtcaccagcggctagttgaattttctattgcgacttatcaaacggatgttgtcccgtatcaaattaattatgacgttttataaattgaaccgatacttggtctgatatgcgctgatgcactgtggtggtcagcgcatttttatcaggtcggaagttcaggcggatgctatgcagataacagtggccgaatatgttgggtgaagactggggccttgccgttaatgctggggcaatggccttatttcagcggaccttaaaaggtgtgttcagacatttagagataggcgagggataaaaatggtgtttatatcagctggtccaaccaacaagtttaaaatacgattgggtttcactattttttacatcataacattataatgttatgatgtttgccaaaaggagggaacgccattctgaaaataatacgtgaattttgtcgaaaccagcactgaatctgttccatgagaaagtaaatatggggtggaacggatgttgattattagctcagcgaccgtagcagcattggttggtcaggattgctgatgttgcgtaattaacaatacactcattggtaaactcatgaaaggaaatgtacaaactttcttggcgcggaggcccctaagacttctacgcataccatatttgtatgactggtgtaatatggataactttatcaacatgttaaatgctaaagttttgccagtagcgaataaagtcggcacgcagcggcatatgaccgcgagtagaaaaggaattatctcaacgctgccattaacgattgtcggctcgttctttaccattctcaataatatgccgattgaagcggtggctaactttttggcgccttacgctgaaattttggacgtgccgtttcgttatacggttggaatcttggccttgtacgcaacgtttggaatcgcatcttcacttgccgaaagttatcagttagataaattaactaatggtgttttagccgtcttagcatttctcgtgtcgaccgcagtaccagttcacgtgactaaaaatgttagcggtgttattagcagtgggcgatacattaacattgctaacttgagtgcctcgtcgttgttcggctcgattattacgggattattgacggtagaaatttttcgttatttaaagaatcgcaatattaccattaaaatgccagaaggggtaccaccagaagtttctaattccttcgtagccttagtcccagctgccgttatcctagtgttgttttggggcattcgctatcttttggactttaatatttcctcatttttaagcacgctactgatgcccctcaaaggtgttttggtaggcaatagtttgtttggtggtctactgacgatttttctcattactggattttggacattagggattcatggggctgcgattatggaccccgttatccggccgttctgggaaatgtcgattgcccaaaatatgagcgagttcactagtggcacgagcgcccataatctgtcgaccatttttactgaacaatttttgcaatggtttatttggattggtggagccggagggacgttagcgttggttgtgttgtttatgttttctaaatcgacctatttgtgcgatctaggcaagttgtccttgttacccggtctgtttaatattaacgaaccgattatttttggggcacccatcgtgatgaacccgattctagggattccgtttattattggtcctttaattactggaagcttagcttacgtgttgacaatcaccggcgtcgttccgatgatgatggccaggttaccgtttactgttccgggaccactcggtgcgtttattagtacaaattggagtgttccggcgctgatactctcttgtgttaactttgtcattgaccttgttatctattatccgtttttcaaagtgtttgagaagcaacagcttagcaaagaatagagggatagcatgtttggaatattgatattagcagcattcgtaatcggcagtgaatggttagtgagtcggggggtgatgccagcatatttgatcaaagcacgaacgggtcagactttgtggcgtgctttactgagtatccttgtaacggtcgggctagtcggctggcttcatttaccagctgtgattgccatagtagtgacgatttattttgcaacaattattgcgaaccgctacctgcaagtttttgaagcaatggaacgggggaaacgcggatgacgaagcggacattaggaatttcgttgtacccagatcacagtgtctttgaacgcgaccaggcttatttaaaggtcgctgccagttatgggtttacgcgactgttcgtcagtatgttggaagtacaagacggtaaagaacgagttacggagaaatatcagcggattattcagtcggcgcatcagctgggcttcaccacgaccctggatgtgtccccgaatatttttgaccaactaggtgtgtcctatcaggatctaagctattttgcgtcattaggagcggatgcaatccgattagacgccggctttgatgggcatcaagaagcctggttatcgtataactcacagggacttaatcttgaactgaacatgagtaacgacgttgagtatttgtctaatattttgtcatacagtgccaatcgaccgcttctttatggctgccataacttttatccgcaacgtgggacggggttgccctttgattttttcgttgcgtgttcacgccggttcaaacgagctggaattgaaacggcagcgtttgtcacggcgccaggcgcaacaatcggtccatgggatatcaatgatggcttaccgactttagagatgcaccgtgactggccgctacaagtacaagtacagcacctcttttcgacaggattaattgatagtgtgctcattggtaacgcctatgcgaagcaggaagatttgcaaaagctcggcgcgattaaccgctatcaaatcacgtttgcggtgacccctagtgcggacatccagcccgtagaacgccagattttactcgataatttgcacgagcggcgtggcgatatcaacgatataacgattcggtcaacagaggttcgcaaacgctatcatgattttaatcgtgtcaacgatgaccggcacacttttcaacgcggtgatgttgtgattggcaatgagcagttcggtaaatatcaacatgaattacaaattgtgcaacagccacacacagatactcggaagaatctggtggcaacgatcaatcctgaccaactcgtattattggatgcaatcgggccgtgggcgaaattttcctttgaggtcgctcatgactgagttatatattcataatggccgagatgttagcggtgcgcccgtggcagttttaatcactgacggagtcattgcggaagtggggactgaactgactgtcccagtcggctgtccaactttggatgcccagggatgctatattacagctggctggattgatgatcatacgcactgcaatgcgcacgcggcgctttattatgacgacgccgatgcaataggttatcgaacgggtgtgaccaccgttattgatgcgggctccaccggtgcggataatgtggctgatttgtaccagcaggcgcatcgggcggctactaatgtttatgccttgcttaatattgcgcgtacgggcattgtggctcaagatgagctggccgatttgaaccagctttcattttcagccctacgaacagcgattcaacgttatccagactttattgtaggactgaaagtacgggtcagtaaatcagtagttggcgacaatggtgtcgagccactccgagtagcgaaacaatatcaagcggatctgacggctcagttgccgttaatggttcatattggtagtaatccccctgaattggcggcaatcatcgcgttaatgcggcctggcgatgtcttaacacactgttttaacggcaagccgaacggtattgtgaattccacgggtgaagtcgcacagtatgttcggaaggcgtatcaaaagggccttatttttgatgtcggtcatgggaccgatagcttcagttttcgaacagcagcgcttgcccgtaccgcacacctatttccacaaacattaagttcagatatttattatcgtaaccgtctgaatggaccagtttatagtctggcagtttgtgtggaaaagctactattgctaggatatcggcttgaggaaattattcctatgattaccaccaatccggcacgtattttcaaattaacccataaggggcagctttgtcggggttacgatgctgatcttacaatctttcagacagtgacggctccccaggtcgttgttgattcaacgggagaagagcgaattgcgcccacccaagtcatacccacatacagtgttattgccggaagggtctacacgtgtggtgtagacaagtgaaactaattatgacgaaaggaaaccgtgccatcggtgagatagttactcactggggacgttagtgaatacatggatatttatgagaaatacgggttgaagcccgtaattaatgcggatgggaagatgacgattttaggcgtttctcaagtcagtgatcaagttgcggccgcccaaaagcagggcgcccagaacttttttgaaatggccgaactgaccgttcagacgggtcgttatttggcagatttaatcggcagtgaggacgcgttgatcgtcaattctgcttcggccggtattgcgcaagtgctggccggtattattggtcgtggtaacgcctatcatgtgactcatccatatacaacgcagatcacgcaacgggaggttatcatgccacttggacatgatgttgattatggggcccctgttgatgtgatgctcgcggttgcgggagcccaacccgtgttggccggttatgctaatcgatgtacggctgagcagttggcaatgcagatcacgccacaaacggtcgcaatcctttacattaagagtcaccatactgttcaaaagagcatgctaacgattgcggatgccctgcaggtggcgcatgatcatcatttaccgctggtgttagatgcagcggcagaaggcgatcttcgttggtatttacaattaggcgtggatgttgtgatttacagtggcgctaaggcaatttcggggccggcatctgggctggttctaggacgtcaaacgtacgtcgaatgggcacgacaacagaactacggtatcggtcgggccatgaagattggtaaggaaaacattcttggtttggtagctgccgtcgaacaatatttaacaaccggtcccgagagtggcgcatcgatgaaagcccgcttagccccctttattgcggaattacaaacgctaccgaatgtccaggttgaaatggttcaagacggcgctgggcgtgatatttttagagcgagtgtgcggattgctgaagcggccaaaatctgtcaggcgttacggcaaggtcgaccagccatttatccacgagaatatcgtgttaacgaaggacttattgaatttgatatccgcgctttgacaagtgctgaaatgacacaaattgttgaacgattacgaaccattattgaggaggaaagcacatgcaactgacacctaattatttaccaaatgggatttgtttgaatgtattggctaattcagtgacgaacgcggaagcttgttatgcagctgcggaaggacacgtggttttgggtgtcctcacgaaaaactatctgagtgatgagtctgccattactgatatgcggcgttaccaagccgcagtgaacaatgcagtttcggttggtttaggtgctggttcaccgcaacaaagtgcaatggtggcgcgagttgccgcagaaatccagccacaacatgttaatcaagtctttactggtgtggcgactagccgggcgttgctaggtcaagccgatactgtgattaatgggctagtcgcgccgagtggtgaagtcggtttggtcaatgtggcaacggggccacttagttcgcagtcagcaaaagcgaatattcccgttgcaaccgcaattacaatgctcaaggatatgggcgggacgtcactgaagtactttccaatgcaaggaacggctcacctggaagaatttaaagcagtggctgcggcgtgtgctgacaatgaatttggtctagaaccaaccggtggactggatctcactaatttccaacagattgtacagattgcggtcgccgctggggtacggcagattattccccatgtatacagttcgattatcgatgcaactactggtgagacgcaaccggaagcggtcgcccaattgctgacgataatgaaacaattctaatgggcggtgacttatgaaaatcctagcgtttggggaagtgttacttcgcttgactgtgcccgaacatttaatgctgacacagactgatgagctgagaatgagcaccgttggcactggcgtcaatctattaagtagtttgacacacttcggttatcgcacgcgactactgagtcgtctaccagacaatgcacttggtcaacgagcagcgggcgaacttcgacgatatggcattcaggatgactacgttacctttggtggacaacatatgggtgcttatttcgtcgaacttgggtacgggtcgcggccggagcgggtcacttatcaggaccggctcagtagcgcattctgtcagcagcctcctgatgatcaggaaattgcggcggcgttggttggctgtcagtttgtgcatatctgcggtatcacgctgagtctgactgcgccagttcgccaagccgcgctacggttagcacaacaggctcatgcgaacggacaacgcgtttgttttgatttcaattatcgtcagcagctcaatacgggagtcgcccatgagacgcttaaagcgcgatatcaggaaattctgccatatgtggatattgtatttgggagtaaacgagacttgacggcgttattagattatcccgatgatgaagatcgcactcaatctgcaaatcgtgaatccgaggcagcactctatgaacaatttgtgcgtgattatcacattgactattttgcgggaagttatcgttatcaagttggccagcaaaagtggtttgctggttttagttatcagcaccgacaactagttgtcggcaaagctcggccattgatgatcttggatagaatcggcagtggtgacgcctttgcaagtggcattattactggcctgattgaggggtggtcactacaaaaaacaacggattttgcaattgctacggcgatactagcgcaagcgacagttaatgatgcgcccgaattcactaaagaaatggttttggcggatatggctagtgacggacaattagaactaattcgctgatgacggtggttgtcacttgataagcaacatgaaattaatgaattttcaaagtaacgtaaaaacgtacttataaaatcaattttgattttataagtacgttttattgttgatacaataactgataccagcaaccggttattataagctgcagttttgataagaatcaagcttgattgctggttgcttcatgataagcatgtaattgagtggcaactagatgggccgggttaccgaccgcagtaacgtgggcgggaacgctgtctaaaacaatcgcaccagcaccaattttactgttggcgccaatcttaatagggcccaagagttgggcgtgggcaccaatgaaagcgccgcgacaaacatagggatgccggcgcccagcttgttcggttttacgtgcgcctaaagtgacgccgtgtaaaattgtaacgtcgtcttcaatgaccgccgttgcaccaatgacagtaccaataccatggtcaaagaagacccggtgaccaatttgcgcggccgggtgaatcagaatcccggtacgccgggccgcatgttggctcagcaaggcggccaataatggtaaacggtgtgtttcaaaataatgggcaacccggtaccaggcgagcgcgtgaataccaggataggtcaacataactgtccgcaaattgatcgcggcggggtcacgattgagaatggcacgagccgtctgaaacaccagcttaatctgcctgaatgctagcgaacccgcgctcaaggtctgctaacaaatcgtcactggcttcaacaccgactgataagcgaatcagctcgtctttgatgccattctgtagccgaattgtgcgtgggatggcaccgtgagtcattaaggctggaatttcaattaaactttccaatgctccgagactttcggcgagcgtgatgacttgtaaatgttcaacgaaggtctgggggttcattcctggttgtaattcaaacgagatcattgcgccgaagccattcatctgttgcttggcaatcgaaaaatcgggattatcaggatcgcctggatagtaaatcttagcaactgctgggtgagactttaagtaagtaaagattttagcggcattattcaggtgggcttgcatgcgcaatgccagagtcttcataccacgttgtaatagccagctttcttgcggggccaaaatactaccgatggcattttgcaagtagccgattttttcgccaagtgctggcgtcttggtgacaaccaagccaccgataacatcactgtgaccaccgagatacttggaagcactgtgtaaaacaatgtcaacgcctaaatccaggggcttctggacgtatggggaggcgaaggtgttgtcgatgatactcagtaaatcgtgtgcttgcgcgagcttcgcaatggcagcaatatccgtaatgtgtaataacgggttcgtcggtgtttccaaataaatcgccttagttgtgggggtaattgcggcttcaacggcggccaagtcacgcgtatctacggctgtaaaagtcatgccaaagtgtttcaaaacggcgtcgatcaagcggaaggtgccaccgtagatatcatttcccacaataatgtgatcaccagccgagaatagtgagaagacggtattaatggcagcggagccagaagcaaatgcgaagccagcgctgccatgttcgagggtggcaattaatgcttcgacggcggcccgggttggatttcccgtccgtgaatattcgtattgattttgaccgatttttgtttggcggaaggtcgaggccatgtagatgggtaccgaagtcgcgccagtagtggcgtcctcactgataccaccgtgaattaattgggtttcaaatttcattgttaaagtcctcatttcgtatagattttttggctcagataacgctcactactgtctggaaagatggtcacgatatgactattggcaggcaggttggtggcaagttgtaaactagcggctagcgcagcgccgctagaactgccaatcagtaaaccgtggtcacgggctaggtgtcgaacttgggcaaaggcatcatcgtccgcgatggtcagtgtctgatcgatgcgaacctgatcgaaaaatggtgggatgaattcgacgccgattccctcagtacgatgtgcgtgagccggtccaccatttaaaatggaaccttctggctcaacgactacggctttggttgctgaatcttgggcttgaagataagccgctactccggcaaatgtcccaccgctaccggctccggcgacgaaggcggttataggtgcaggcatgtccgccagaatttctggtgccagtgtgtggtaataagccgcgggattagcaggattcttgaattgcatggggacgtaactgttggaaatcgttgcggctagtgcctcagctttgcgaatggcacctttgattccttcctcgctaggtgtatgaacaatttcagcacccaatgcttgcattaaaacttgtttttccatactgaacttttctgggacgactaagatggtacgtaggtggtgcgcttgagttgctaaggctaaaccaattccggtgttaccagcagttggttcaataatcgttgtcttggcgttaacccagccccgttgcaagccgtcttcaatcagataggctcccagccggtccttaatactgccgccggggttgaacatttcaagcttggcatagatgtgactgtgatttggaacctcgatgggtaacgccatcaggggggtgtggccgataagttcttgaacgtgctgaatgagcatataaattcctccaatcgctgcggtggggtgccaaaagcgacaaaaaaggcgcgagaattcgaatgaattcctcgcgcccagtacaatatccagccatgctggacattgatttttaggatgacactcctcaaaaagtcaatgcttaacaggccgaacatcgcgataagcgcacagttcggcaacaacagttattcaaagcactacttgttaattgagtcatgtctgatcctcctctggattaattgggactaactatacaagatgattttgagcgcgtcaagtggtgaatgacgatttgcaataagcggtaaaagatgaagattggctgagaacgttattgaatcagcgttagttttgccaaacggttgtcattaaaataaatatattaggtggttgaatcagttgattgtgaccgaggataaagatgttaaaatttatccaatatcagtttttcatgtcttataatcaagacgttttccaagacacatataactagttttattctgacaatagctagtgaacgtgctgttgataataactaaaacaatcccaccctgattagcaagtgactaaactagggtgggattgttcgtgattataatttaaatgatattacttattccataagtatttagcatcaaaatcattatcgaatgatgataaaatcttaggaccgtcatcggtaacgacaagggtgtgctcgtattggcagctaagactgccatctaaagtgcgaacagtccaaccgtcatcggcagtttcgccagaacgccagtcaccaatattgaccattggttcgatagtaatggtcataccagcttttagacgggtgccgtgaccagcttcgccataatgtggaacatcaggcttttcgtgcatcgtcggtccaataccatgaccaatgtattcgcgtacaacgccgtaacccatttcgttttcagcgtaattctgaatagcccagccgatatcaccaattcggttgccaacaacggcttggtcaataccgaggtatagcgctttatgggtcacttccatgagttttttaacttcgggtgatggtgtaccagcaacaaaggcgtggcaagagtcactaaggtagccatggtagttaataacggtatcaacttttaataagtctccatctttgaccaagatatctttactaggacagccgtgacaaatcatgtcattgacgctgacacaagttgagtacttataaccttcaaagttgagttcgccaggagtagcgtcgtgtgcaacgatgtattcgtaggcaaagtggtcaacatcccaagtcgtaattccgggcttgatgtagtcttcaagggcgtgaaacaggccaaccatgatgtcaccggcagcttgcatccctttgatttcgcgatctgatttaagcgtaatcatgaggttcctccaaaaaaattaattatattgtgatgctaaaagtttgttcctctccagtatactgcaagcattgtattgcgacaaaacgcattgttttgacctgatattgacaacgctatcagtaggccgaaatcaaaaaaatataaaaaaatcagcacgccaaaaataccaaattgccggggcgcagttggattaattgtaaacaattcaatataaatttggaattttacccttttcatcggccaagataatgatacaatatattgtgttgttttaaacggaaacactacatgtagtagtgtgacgtgactggttggccaactagacacctacaaccgcatatgaaaacggaaagaggagcatgattttgagtaattattttaaattcttatcacaccaactaaaaggttggccacaacagaactactatctattctattttagcctaggatgtcaagtaatgacgttagtaagtgcgccaattacagcattgtctattttaacatttattgggaccactttgggtgttctttgtgtgttagccattaatgcggctaagtcagtcaatggattattaggcgtcatctccgccgcttgcttcatcgtagttggtttttcagctaagaactatttaagcattggggaacaattagcctacgtcgtaacgcttgatattccagtactattaagtgctaattggaacgtcaacatggtttcaaagattcggaagtttacgggtaagacgtggatcgtcgcaattgtcgcaactttagttgtttatgccatctccggctatcttattggtgccttaactgatgatccccggccatgggtcgatgccattagttttgcgatttgtttaacggccggcgttatttgcttcctccgttacaacaaccagtatttctggtggattgcctctggtttagcacaaatggtcctctggttcatctcgttccgtcaaggttcggcgacactagcaatgttcatcaatagttctgtttatctgatgaacgatgtcttggctttcactgtttcaccttggtataacaaacatgaacgcgctcggttgatggccgaagaacaagcagctagtgatgcagctagcgcggatgctagtgataatcaggcatttggattgaatcactaaaggtcagctaataaatttactgagactagtagcgctaatattctaaataaggcgagtactgtaattcttttggattagagtactcgtttttatttgaatagctccggattgtatcagttatcaaatatatgcttttttattgacattataataaacaatgttaaaaaagagggatgctatggactggtttgtgaatttagaacgtgaggatcaggaatttgttaaacaattggttattgcctcaggttctctaaaacaactcgccaagatttatcaagtgagttatccaaccgtgcgaatgcggttaaacacgattattcaaaaaattaactttattgaggacaacggtgcaaatacatttgaaacgaaggttatgaaattggtaatcgatgagaaattatcgttagaggtagcaaaacagattattactgactttagggaggaacaacatgagtgattttaaaggaattctgcttggtatgttggtcgttgcagtgctctatatgttagatcgatacttaccaaggtggtttggggcaattccgggagctggctttttaggctttattatttacattgtttttacaaaagaggtctctttattatcaatagtaaccgtattgttagttggcgaagccgtgctgaatggtatctggatagatgcactcgtgaaccgaaggagaaaaatgaaaaaagaagtagcaacaatgaaagcgaaagatttattgcgaaaatagtaatattaatgaaatcatcagatatagaatcgacattggttggagattgctgttagcgctctgcgaatgtcgattttttattatggtgcggactatcctgctagttaaaccaatactgtatagatgctggtacttattatgaagtagttattgaatactgaaatataagctcgaattttgtgaactctagacatgtctagacttgatctggctggtataatctacaaatttaattgggttattacttaaatattgacaacttgtctaaacaagtctatattcataaatgaaaacgataacaaaggggtggttgccgtgaataaagcggccttagtttatcaagatttgctccagaaaattgatgcggaggtttacccgattgggagttatttgccgagtgaacatcaactttgtgagctatatgggatttcacgtgagactgggcgcaaagcattagcgacattggctgaggatggctatattcaaaaaattcgtggtaaagggtccattgtgattgagcatcgacagtatgaatttccagtttctggcattgtgagttataaagagttagccgaaaagttacacattaagacgcaaaatattgtttatgactatcaaccggatgcaacgttaccggttgctgactttacgtcacttggtaccgaattgacggaagcgccagtgacggccattaaacgagtccgagtgatcgatggcgaaccggctattattgataaggattatattttgaaatcgatcattccgaaagttcccaagcaagcggcggaagactcactgtacgcttattttgaaaatcagcttgggttgacgatcggttacgcgacgaaggaaattacgatggcgccggcaactgatgaggaccgcgaacaccttgctattagtaagggcgcctatgtagcggttgttcgaagcgtgacgagcctcacggatgcgcgcgcgttccagtatacggaatcacgacaccgggcggaccgctttagtttccgcgattttgctcggcgaactaagaaataagatgtggcatgagagggatagcgcatgaaattatcagaacaagtgatttatcagatttatccgaagtcgttttacgacagcaatggcgatggcgtcggtgatttacggggtgttattgaaaagatcgactacctcaaaaagttgaatattgacatgatttggtttaacccgttttttgtctcaccacaaaatgataacggttacgatattgcagattactaccatattgaccccatgtttggcacgatggctgattttgaagaactcgttgcaaagctgaaggcaaatggtatcggggtcatgttggatatggttcttaatcatacttcaactgaacacgagtggtttcaaaaggctttggcgggtgatgagaagtatcagaagttttactatctccgtcctcccaaggctgatggtagtctaccgaccaattgggaatctaaatttggtggtccggcctgggcgccgtttggtgatactggtttgtactatttacatttatatgatccgactcaggccgatttggattggcataatccggccgtacgacaagcgtgtgccgccgttgtcaacttctggcggcaaaagggcgtgcagggttttcgtttcgatgtcatcaatgttaccggtaaggctgagaagttggtggacgcacctaagggggtccctagcaagacgttgtatactgacacccccgttgttcatgagtatttaaaggaattgaacgcggcaagtttcggccaggatgtagatagcgtcacagtgggagagatgtcttcaacaaccgttgcgaacagtgttggttatactaatccggctaatcacgaactctcgatggtctttaatttccatcatttgaagacggattatgttgatggacggaagtggtcccgaatggccttcgactttccacgattgaagcaattattagatagttgggccagtggaatggcagctggtggtggctggcaggcgttgttttggaataatcatgatcagccacgagcactgaatcgctttggtgatgctggtcggtatcgtgtcaagtccgctgaaatgctggcgacggtcattcacctcttgcgtgggaccccgtttatctatatgggtgaggaactcggcatgactggtccggactatgacaatatggctgattacgtggacattgaggcattaaatgcttatcgggctttaattcgtagtgggtacagtcatcacgatgcgtttacgatcgttaagaccaaggcgcgcgataactcgcggacgccgatgcaatgggatgatagtgccaaggctggttttaccactggtaaaccgtggttgacaccgactaatcaggcgacgattaacgtagcccatgaattggccagtggcgagatttttgactattatcaacggctcattaagctaagaaaaacgatgccgatcgtcgcggatggtggttatcaatcgtggcgcttagatgatccgcaagtcttcggctattggcggacatatcaccaacaaaagttattagtgcttaataatttttatggtcagtcaacaacggtgacacttccggaagaaatggtcggtgcacaggtgttactttccaattatcaagatgttaatgtcacagcacaattgacgatgcaaccctatcaagcggttgcactgttgttaggttaagaatggaggaatgggtatggcaaaggcacaaacagtaacaattttgtcgccggtcaatggggacgttattgcgttaaataaggttaaagacccggtcttttcagccggtatgatgggactgggctttggcgttcaacctttaagtggagaagttgttgccccagtcagtggtcaggtcacgatggtggctgagacgaaacacgcgattgggttcacaacgcctgatgatcatttggaagtattagtgcatctcggaatcgacacggtcgacttaaagggagccccgttcacggtcaaagtggccgcgggcgatgatgttcaggcgggtgacgtgattgccaccatggatttagctgctattcaagccgctaatcgtcagaccacagtgattttagcagtgactaacactagtgataaattagaatcgttggacgtcgttacgggggcaaaagctgccggtgacgtgacagctacgggccgtctgaatgctaacacatataatgctaagcggcagaatcgattaccaaaagcgggcaaatatgatcagttagccgcggacatcgtggctaatgttggtggtgccgggaatattagtagtttgattcactgcattacccgcttacgtttttatttaaaagatgaaagtaaagcaaatgatgacgtcgtgcgggacttaaaaggagtcatcgacgtagcaaaagcgggcggccaatatcaggtcgtgattggtcctgctgtcacggatgtctatgatgcagttatcaagcaaatcgggccagaattttcaaacgattcagagacggctaaagctgttgctgagactgccgcagcagctcagcggccaacgacgccgtggggcaaagttaaatggggtatcagtaatttaattggtgttatcacgggttcaatgattcccgtcattggcttattagcagcctctggtattttaaaaggaattcttgcgttacttactacgtttaatttagttagcccgaccgcaccaacgtacgtgattattaatgcgatgggcgactcggtcttttatttcctgccaatcttcgttggttttgcggctggtaaaaagttaggggcagatccggtgatcatgggaatcatcggtggggtgctgacttatccagctattgtaacgatggcgagtggtaaagcgacgagtacgcttttaggaatggggatcaacgcgaacttctttggcttgccggtacacgttgcctcgtatacgtattcaattttcccgatgattgcgggggcctggttagcaagtaagttggaaccatggttaaaacgggtgattccaacggtattacgaatgatctttgtgccattatttgaagttgtgattgtttccggtgcgattctattattccttggtccaattattaccgtgctttcaacgggattggcaaatattattgtgtgggtctacaatttgagccctgcgatttctggcttaatcattggtggcttctatcaagtattggtaatcttcgggttgcattgggcggttattccgattgtggccaacgatattgcaacgacgggccacagctacttgaacgcgattgtttcagcgacgatggttgctcagggtggtgcggtactcgcaatctccttaaagtcaaagctggctaacattcaagaacttgcttggccagcaacgatttcagccttctgtggtgttaccgaaccagccatgtacgggatcaacttgaagtatggtcgggcctttgtgactgccagcattggggcggcagttggtggcttcttgaccggcttgatgaatgtcaatatgtggggctttacgggttcactgattggcttcacgtccttcgttaatccgaagggcttggactttagtttttatggtttcgtgattgcatctgcagccacgattgtcgtgtccttcgccttaacttggatgtttggttttaaggatgaagatgtcaacgccgttaaagtagcgcctaaaaaacggcacttaggtgcaactgtctagttaatggcggcgtcaaataattaatcaacgttaggataaacaagtgtttttccgattcggaaaaatgcttgtttttgatatttagtcgccctaacgaagcgatggtaagcgatggagattggtctcattgtgatgatagaattttagtggatcatgattggacgtgaaacgatcgtcttaagaatttttgagggttaggtcaaagttttacatgggggatgacgattatggggaaaatcgatgaagtatccattttagcaccagttactggtcaagtattgtcattggcaacggttccggatcctgtttttgcggcgggaagggtagggccgggatttggtgttcagccgacagctggtcacatcttggcaccagttagtggtcgaatcacagtagtcgcaacaaccaaacatgcaattggcatggtgactacgactggcctcgaagtgttggtacatctgggtgtcgatacggtggcactcaatggggcaccgtttgaagttcacgtgaaggtcggtgatgaggtgacggctggcacactattagtcgacatggatttagctgctatcgagcaggcccacaaaccgaccacggtgatcattgtcgtgacgaacgctcagctggtactcactgacttgacgctagccccactgccacaagctgtcgcggccggtgcagtcgtcgcaacggctcacttgataacagtgacaacaaccgcgtcaccggtagtggcagcggtaccgcagtcaacgacgcgttactcggcattagccacggcaattgtagctaatgtgggcgggcaacaaaatattaatagcgtgattcattgcataacacggttgcgattttatttgaaggatgaagcactagcgcacgatgcggttattgcgaacttggacggcgtcattgatgttgcaaaggccggtggtcagtatcaagttgtgattggtccggcagtcaacgatgtttttgatgcagtgatcgcacaactagggcctgaatttgcggacggagtgccagtaccaccggttcaggaggcatcaagtgacgttaattggctaagccacgtgcgtaatggcattagtggtgtcattggtgttatgaccgcggcaatgattccggtgattggcattttggcaggttcagggattttaaaaggaatcttggccgcgttaacgggcttcaaagtcttggcggtcacgagtgggacgtatatggtatttaacgcggtagctgatgcaacgttttactttttaccagttgtcctaggctttactgctgccaaaaagttaggttcagatccaatcgtgctggcgattgtcggtgctgttcttatctatccaagtctgataacggcagctagtaagggagccacggcccaaatcacgttcttaggtgttccgacgcatttaatgtcatattcggcatccgtgttcccgatgattgtggctgcatggctaggcgtgtacgttgagcgggggttaaaacgagttgttccgctgtatttacggagcgtctttattccgattatcgaagccctgattttggcgatagtggtattagtggtggtcggtcccttaattacgattatcagtaagggcttggccaacggtttggtcgccgtctataattttagcccggccttatcaggattggttattggtggtttataccagacgatggtcattttcgggctccactggggcattattcccattgtgatcaatgatattgcgacgaaagggcacagttatttgaatgcaatcctctcgattacaatggtcgctcagggtggtgcggtgttggccgtcttcttaaagtctaaggataagcacctaaaggagatctcactggcagctgcaatttcagccttttgtggtgttaccgagccggcgctatacggggtcaacttgaaatacaaacgggtctttgtcgttgctagcattgcgagtggtctaggtggcttactgaccggtctgttacgcgttaataactatgctttgtcagggtcgttgatcggtttccccgcgtttatcaccccgggtgtcggcatcgggtcaaatttttatggttatttgatatcccattacgggacactagtgattgcaacgatgttagtttatgtatttggcttttcggataagttgttaggtcctaaggaaaacttaaaagcgactaataatcagtaactaaaataaggctcctgctgaacgtagcgggggtcttatttttatgaactaatcgcttgcaagcgtgcttgttgtcgaatcgcttcaacataaatgcggacaaagtcggtgccatacaggactgctagttgctgttccagatttggtgtgggtggcaacacctttagcaagggtcgaatccattgattggtgggcaatagtcgcaatagatggtggctggtgaactgtgagaataggagattgcggccgaagtattgtccaagatgattttggaaagctggttgcttaactggcaccagttggagactactgttattcatgttgcctagtaacaatttggcctgaccaaagtcgtcacgaaggtcaaaatgctgattcttgtaggccttagcgatttcaggtgctaattggaccaaccaaatgagctgatgttgttccaaatgcagaatcaagcgcagtgtcataatatcagttgtcgtgagttgataactgtattgttgcagagtggctggtgttaattcttgacgcaaggtccgttgaacggcgtcaaaattaccagcctcccaactaatggttaattgatcatggttcgtcagccatagcaaatgatccgcgatccgcaaggtcaaaaagcgcggggcagccgtccccggcgtctttagcattagtagccagtaagagctggcactagaacgcgcaaaattgcgtgctaagacgtgcgcacaggttggcaaggctaattggacagccaattgtaagcgtcgccggtcagtagcagtattaacaaactggtgtgggtcgtgtgtgattcgtcgttttgccatagacatccctccctcattaatacactaccttaattataggccaaaaaacgtggtgtggcgcattgaatgtttggttttaatgataaatcaaatgttattagagtcgtttgattcgctgatattccagttaagaatattaaccagtcaaaactcgatttgtttcaaccaatcgcgcaggttaagataaagatgaaggcttaattgaatcataatatcattaatctacagaaacggggcgatgttgtcatgaaacgaattgttgtgggaatcacgggagcgtccggtacgatttacgcggtcgacttattagaaaagttacatcagcggccagatgttgaagttcacctggtaatgagtgcgtgggctaaaaaaaacttggagttagagactgattactcgctcgcgcagctgacggtgctcgcggatgctacttatcgggctaatgaccaaggcgcagcgattgccagcggttcgtttttgaatgacggaatggtcattgtcccagctagtatgaagacggtagcggggattgcgtacggcttcggtgataatttaatatcgcgggctgctgatgtcacgattaaagaacaacgtaaacttgtgattgttccacgtgaaacaccgttaagcgtgattcatttagaaaatctaacgaagttggcaaaactcggtgcccaaattattccaccaattcccgctttttataatcatccgcaatccattcaggatctggtcaatcatcaaactatgaaaattttagatgcgtttcatattcataatgaaactgatcgccgttgggagggggattaagtatggcaacttttacgactgagcaggccgggtatcaaatacaagcaacactccaagtgattggatatgacttgttgatcgtcgttaccggtgggaccaatccccatattggtgatgtgaccacactaactgccagcacggttcccgaaacggttaagtttcccagccatgatggtcgcttccataaagataactttatttcggaacgaatggccaagcggattcagcgttatctagctggaagctgtacaattactgcgggaattcatgtcaaccaaattactaaagcacaaatagcagctgcggcaccaatgacggatgacctcagccgccagattattagctggttacaggcccatcccgtccaggctgaaaagccggaatattatggacaatacgagcaaccgcggtagattcgtgacgcatggggtgtcgaaaacagcgcaatattgtctttgcgccctattgctggataatatgcaccgagctggccgtttattgttattaaagttgtactagatggaataattcaacaaaaaaattgcgcttcagatgttgattctgaagtgcaattttttgtccaagttaggcataaacatactagcatgtttgtatttaaacggagtggcttgcagggtgaattatttagtatcgacatgcgcgctggcttccgcaatcgcacaccgtcagctaatctggcagcttatttgtgggcatctttctttgcttgttccactaaaatgttatcgaccacgtcttgtaagctagtcttagctaaccgtgcttcggccgccgtttgcgcgtcttgatagtattgtttcagaacggtttgaatattgccaccaacaatacaatccggattggtcttaggatcgacggcgagtagcggcttatcgccctcaattgcgtagaagacgctgagcagtgaaatttgacttaaaggtttggcgagtgccggttgagcagtaccgggcgttgttgtgattagtccggcttgtcgaagcttgctcatcaatcggcgaacaacgactggactagtttcaatgctgcgggcaatggcgtcacttgttaatttagtatctgcgtaaattttaatgtaggctagtaaatggatcgagtcgctaaagcgggttgaaacacgcatataatcacttcctgtaacttaattggttactatgattataaataaatccacttataaaagcaattaacgagtttagtaaagctaatgatgtaacttttataaagatggttgttttgggggaccgaatcagttatgatgtaaatgccaaaattgagcagttactgcaaaaaaggagcttatcatcatgagtgaaattgaaaccatccaggcctattatgcggcttcattggggaaggatggtcgtattacccggacccaacggcaaattttagccgccgcgctcgacttatttgcagaaaaaggttatgaagaagttggcactcgggagattgcagagcgggccggtgtcgctgaaggaactttatttcataattttgttaataagaacggtattctggacgccattatgcagccgattgtgcagaatattttgccaacgatgttgaacactttggaccaggcagttttagatagtcctaaccagactttgcaagcatttgttgtcgcccttgtgcgcgatcgggtcgcatttgtcacacgtaaccgagcctccttagccgtcattttgtcccaatttttcaataatgctcaggatcgagcggccgtcttagggatggtctcacctagcattttggcgcaggcgaatgaagcgatggatcgcttgaaagccgctcgagaattagttgattggccgaatcgcatgattttacaattggtgttttcaaccattgggggatatttagtcgaacaggttctctacccacaactggatgatttgagtgatgagcaattgattcactatctcagtgattttttagttaatggtttgagcccacggagaatccccttacaagatgataataccgcgtcataacaagctttagggatgccaaagtaataattaataatagttgactaataggttaatggtgctatactaccaattggaattaaagtgagtgctcaattaaggggacgcactgttgaggatcacgtagtagtccacaacctgaattctaaaccaatagaagagagggtttcataatgaaatcagcaaaaacgaaggatcacgctaagatgaaagctgccgaagaaaaggcgattcattcaacgggtgccgatagtaagagcttggacgaagtcaatgggagtgtccgggtccctaaggatgccagcttctggcgaactttaattgcctacactggaccgggtgcactagttgcagttgggtacatggatcctgggaactggatcacatcaatcgcaggtggatcacagtacaaatatgcattactttctgtgatcctgttatcaagtttaattgccatgttgctacaagccatggccgctcgtctgggaattgtgacgggtaaagatttagcacaattgacgcgggaacgaacgtcaaaaggaatggggatttttctctggattattactgaactagcgattatggcgaccgatgttgctgaaatcattggttctgggattgctttgaagttattattcggatttccattaattgtcggtattttgattaccactgccgatgtcttgattctgttattattaatgaaacttggtttccggaaaatcgaagcaattgtggcaacgctggttgccgtgattctcttcgtcttcctgtatgaagttattatttcacaacctaatattccagaaatgttaaaagggtatgtcccaactagtcggattgtcagcaaccgttctatgctatttctagcactcggaattgttggggcaaccgttatgccgcataacttgtacttgggatcatcaatctcacaaacacgtcaagttgaccggagtgacgaaaaagaagttgccaaggctgttaagttcacgacaatcgactccaatattcaattgtcagtcgcgttcgttgttaatagtttgctattaattcttggcgccgcactgttctttggaactaagggggatcttggccggttcgttgacttgtacaatgcacttggcgatagtaaggtcgttggctcgattgcgagtccgttactcagtatgctctttgccattgcgctgttgtcttctggtcaaagttctacgattacggggacgttatctggtcagattatcatggaagggtttatccgtttgaagatgccactctgggcacaacggttactaactcggttaatctcggttacaccagtgttggcttttgcgatttattatcatggcaatgaagcgaaaattgaagatttactgacgatgtcgcaagtcttcctgagtatcgcgttaccatttgccatgattccgctagtcatgttcacgagtaatcgggcgctgatggggaacttcaccaaccgtgtctgggtcaagtggacggcttggatcgtgacggtgattctaatcattttaaacatttaccttattttacagactatcggtctggttaaataatcaaacattaaaatgagctttccagggattgcaaagaattcctggaaagctcattttgtgttttgggaacagcggcaatgcaagataccgattcaaagcgccaagtgctaatacgtaccagtaattggcgcttaactgactttggatggccagtcttgcttagttggtatgatggtaaacggggtcgcagtgatgaggtccgtgaggcaggggagcaacccggtttcaaggttatataaatcgtgaacgtgtgcgctagtttgaccgtgctcagccatcttaagtagttgaggctgggtgaactggagttgactggctggtagaatcaggtccggttggctgcggcgtgtcaacggttgggcgtggtcgtgaaccaggtaagcaaaattaggcgccgtattgagaattagcgttaaaacgctgatttcatggggatctaatttggttgctaactggttcgtttgactaggggaataaaccatggcggcgtagatttgaggcgccagctcgggtaattggcggctaggtggtgtcagggtgaccgtcagtcccaattgccagctggcgagcaacaatcccggaatcgttacgacttgtgcggggctcagtagaatggcttgtccggcatgcacgttctgttgttgcagactagtttcacacagtgcgaggtcttctaaaacatcggccccggtataccagttgccatttagatctttcagaactggttcggcatattgacgttgtaattggcgggtaatggccttagtcagctgactcatcgcggggcctcctttaagggtttaagtgacggggcggaaattaagggtggcagtactactttgcgttagtgagatacttcatcttagtgatactctggctactagcgtcaatggttgctaacacttgattttgggtggatttaacgacaagcttagttggctgtggtgttaaatcatgtttcggctggtgggtcgtggtacccgttgcgagtttagtatcacgagtaactttgttgacgagtgtggtggatgtcacttcaggatttgttgtcgtcgtgtcagcagaggcggaaacggaagtcgcaaagagggttccggcagccattagagtaagggttagttttttgaatgtgtttttcataataatcgaactccttttagttgttattattagtgaatgattattgggcagctggcattaaccagtcgttagagagtagttgatggaagtgacgaccaagtgggacccataattgcgaacggcggatgttttttaacgtgtcccagaataatggatcttgtagttgttcatcactaagtttgactttaacgaattcgccctcttcagttttcgcaatcaccagtgggtaggtcaccttaaccaattgaacggcggtgatatttttaatttttggatcagtatctaataacatatctacatagctccttagttgttgtgagtcattctatttttataagttaatttttaaagttggtttgtttaattgaatgactatagtttaccggcatatcgccgtgggaactatcgactttccataaactttatctaagaaattcttagattcagacttagaatataaaaaataccatgaaaattgaatctgagcaggtaatactttggcaggatcaagtactagttaaattaacaaccgtttcaagactgttaatgtccttaaaacggttgttaagagtttatttgtaaatgaattagcttagtgtgcagggcggttaataatactaatggcaaagcctgataaagcacaaataagagaaacactaaaggaccaggttaaaccatgggcaaaccaagcaggatgtgctggcaagtaagtactaactcgatatccagcatcgatgctcattgttgtaaatagtgcaagagaaccaagtgcgacgcctaaaatattgccaatattatttcccaaagactgtagagaacccgctactcctagctgattttgtgggacgactgacattagtaatgtgttatttggtgcaatgaaaaatccagtgccgataccgttggaaattaacaaagaaataatgagggttaatgaagtatgtgaatctaggaataagaagccaatttgcgtaattataattaggactaggccggttagtagaacaagctgttgagagaaaagatcactcaaccagccaccaagtggggcagcaatagccataataagtggaaaaatcagcattaatattccagtagtaccaactgaccagttcaaataatcttggagatagagtgggaatataaagctgaacagtgcattaataagtggtatcagcattccgactagcaatgctaagctgaaggtacgatttttaaaaatggatagtggtaatagcgcattttttcgatgcttttccaaataaataaagtatagtgtaagtgctaatgtgataatgaagccaatgataattagcggctgcctgaaaccaatagtctgccctgcttctaatacaacaaagaatagtgtgatgataatgaatagaatccctgcgccccaaccatcaagtttagtggcttgttgccggccatgatttttgggaagaaataggtggcctaaaataatggcaatgattccaagtggaatgttaatcataaaaatagcattccaagcaaactgctgtagtaaaaagccacctaaggcaggtccggcaacaaaaccagcggaaataaacattgtattgatacccatggcagttccccgggtgtgattatcaaacagttccgaaattaaaccatagctgtttgaaagcgttgcggcagcgccaactgcttgcacaaaacgagccaatagtagaaactcaaagccgaagttgacactggccattagtgagccgatagtaaagctatacatacctaaagtaaagattctacctttaccccaaatatcaccaagtttaccgaatgttaccagtaagcctgatagaatgaccatataacccatcacggtatatgtgatctgactaattggaaccgcaagtgattttgacatgataggtagcgcgatattaatgattgatgcatcgagattagccataattgtaaaaataccgatgacaatcattgctaaccaagaacgagttgttgttttcatgataaaaattcaacctcctattttttgaacatttgaaagtataacaagttcgtgttacactaacgcaagcaaaatttaggaggatacgagtatgtttacaattacggcgaccgctcagaaatatggtgtgtcgaataatgcactacgttactatgaaagtgttggtctaattggcccgattaagcgtgatcaaaatggtatccgacaattttcggctagtgatcaagagatggttaaccgaattgtacatctccggcaattaggcgcgtcaattaaagagattcagcaatacagtttccgtcctgaagaagtaacactagaacgtacagttgcactaaaaaaatttctgttacatttaaacggagatctagaagcacaagaggcacgaattaaaatagaaaaacaatatttaaaagcaaaaatagagcatttggatggtgatattttgagtatgaaatctcataaaaccacgcagatgggttagtagtaattagtttctgcatatcaattcagaatagtcttggaggtatctttgtgattgggtggcccaagaccaaaagcgagtcttagatttttctagtgactcgcttttttatgagagtaattatttaggaaataaaataatagtacttgttactatagttgccagctgaccgtaaagacactcccggatggctggttgtcggtaattttaatggtggcctgattcaatgtaactaactgttgaacgattgctaagcctaagccactgccttcgattgcttgtgaccgagattggtcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaaggccacaacgatttgttgtaacatttccgcattaccttgaacgtggatgttcggatcaattgcgagcgtcaatggttgatcaattgatggctggtaatgttcagccagtgacaacattaatagtgataggtcttggtcagttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgcgaagcatcagaaataaattgacgctcatgctgcaatcgttgattttgcgtgaccaacagttcattaaaggcccgaccgaggtcgttgatctcgcgggggctagcaggcacgtctaaggtgggctggtcgctatccggattgttcgatgtgtacttggttgcgtgtaacagtttaatggttgggtcactcagtcgcagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcatagtctgttgcttggtgaaaaacgatttggacgatggggtagtgatgatcgtccgcttcgttttagtggcggtcgtcaaggttgctttcttggtggttacccggataaatgccggttgtttcgtattgcgtgtcgtcgtattgttccattgaataaaactggggacgtctttgatattcgcctggttaagactgctcatcaagtcacgggcttccctagtcgtattgattgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcaccgtttgaatgagtggggaggcgccggttgtcgtgattttattacgtaaataaccgacataaacgtcaacgacattttgctgaccgagaaagtcggcgccccagacttggtcaagcaagtcatcacgggtaaagacttcgtcgggatgagcgaggaagaattgcagcaaatcatattcacggtgagttaaggtaacttcttcctgcccgttagtaacgcggtgagctttagtatctagctggacatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccgtcaagttttggcaacatccagtctagcaggatgaggagcaactcgttttgatgcgcttggtaggtttccatagctgccaaaccgtcagccgctaccaaaacgttgaaatcctcaaattgtagttctttagtcaagtagccagatagactgccttcatcctcaacaattaaaatcgtgtttttcaatgttatgctcctctcaataaccctggtttatgtctaattatagcgaataattatgacgcttttccgatattttgacttatttttatggatttgtgtgaactaaatgaaagcgtcaccggacttatgctaaaattggactatgaaaatggaaggtaagtgagtgacatgggactttttcgtgacgccatgcaggcactgtatcacagtggtcattatggttacaacatcaatgtaaagaagtcggctcccgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcaggatcttgagatcaaaccgcagatcgatggtcggtggggcgatcaataagcggaatttgttcccataaattctaatggtcatattaatttaatgatagaccaattaatcaatagtgacggggtgagtcaatgttttcgtacgatcaggtccagcagttaaaccgcttggaaattgaaatttataagtatattgtgggtcatcccgctgaagtaagtactatgacgattcggcaattggccgaccatagtcacgtctcagcaacgactattttgcgttttctaaagcacatgggctatgatggctacgcagaatttaagttcacattaaaagaacagttacggcaagatgccacacaaccgttagctcagacagttgtaccgatgcggacgttttttgaccgcatgaacttacctgatatcacggctaaacttcatcgggtcgcagaactggttcatcaagctcgaatggttgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccgtcgtttattatctggaacaattagctatgattattcagccattaacgtaaaggtaattcaaaccaatctttggaacatgttctaaaaatggaacaaattccgatggatggaacaacacccattttagagtgaaagggtatacattttgagaatgacaggtataatgaattttgtaggaagcgtattcatgggtacaaatgtcagatgacaggactactttgtaacggacgaactcaattttatgtaaacggttaactattgattgaccgttagcttacttagattattctgattgtttgagaatgttcgttaaatgaatatgcacaacaaattattttagggggtcacgacatgagcgaaaacaataacaagtcgagctttgttaatgaccgacttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacgatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggttttgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaatgcggaagcgcttaaggctggtaaggctttaccaaacgttgtgacacaacaattcttcgacaactttgtccacatgggtggttccggtgcgaccttgggactggctttcatgattgcctttgttgccaagagtgccgaattcaagacattaggtaagctggttatcggacccgcattgttcaatatcaatgaaccaattgtcttcgggttgccaatcgttatgaactatcggattgccgttccgtttatcttggcaccgttagttaatgttacgacgacttacattgcaatgtcgactggcttagttgcgaagaccgttggggtcatggttccttggaccacgccgccaattatctctggttacttagcaacgatgcacatctcaggtgcggtattacaaattgttaatattgtgcttgatggtgccatctactacttcttcttcaaggccttagatcgtgataaggttaaggaagaaaagacctttgctgctaaagaagctgctggcgaaacggtcgaagcttaagttaaatcattaatgtagtaatcgtataaataccaccattagcgacttgttgaaagtctgttgatggtggtattttaatgtcgacttttgagaagcgcgtgcaaattaaagcgaaccgagtgacttggaattgtcaccgggttcgccttttattaacgggtatgaaattgtgggtgcaacattcggggatgaccatggtcagtacccttgtactgcaatagccaataagcgttttgcggcaaagcgctacgggcaatgacgtgtgcaacggtgtagcgaatcgtgtcggcattagcgtcagtccataaacgccaagttggtaacttagctgcttgaaccggttcccaatcgcccaattcttgttcactagtagttagtgcggtgagtaaatcaggccgttcggaaccagtcagttcgatgtagtagcaatacgcttgcgaatgcagggtgttgggctggctcatgatgagattgctcctttggatggttttaacgagttatcgttgacttaaataaccttatcatcaatcatagtacaaccgtttgactaaattgactagcttttttgcttactgttattaaaatgtaatattcaaacttgcaattaaaaataattgagtgttgcgccttgacctggaacgcgtttcagcacgtatattaagtggtgaaaataacgagggggtgcagcacgaatggaaatgggaattttaaaacagattgatttaacaacgacaacggaacggtatttcttcgtgcaagtacaacgactggccgactatgtctggattcgctcagttcaaaactttaagcctttagaattaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaggcagtaactgtgatactttaggcaatcaacaaccaataatactaatggcagcaatcaattttaactaggctaggactaaatcaggcgcgccactgaaggctataatgcttcagtggcacgcctgattatcattaaaagatcacttggtattatcactgtaagtgattttatctaaaccttgggtgtcataattgagattggttttgccgtcatacacggtattcttggcatttagcttggtttccatgttggtaagggtctcagtactgagtcccagttgggtccgaaggcggtccgacatttgttgcaaggtcttcgtacttaaaatctgataggaactcgtattaatccaagcgggtgagccaatgacttgagtcgactggatgtgtttcatattggcacgatcatgcgtcgctaacccaacaaggtcgttaaagctaaggtcagtttgtaaattactcttcagtgaagtgagtaattgattgtagcgactataggtcttagtctcggcgagtttggcgagaaccgcccgcatgacttgttgttgccgtaattgacggccgtagtcgccccgggggtcctgataacgcatccgtgtataagatagtgcctgtttaccattgagatggtgtttgcccttggttactgtgatgtggtcgaatgaaacgttgagtggactggtgatcgtcacgcctccaacggcatccacgatttgtttgagaccgcccatattgatagttgcatagtaatcgataggcacgttaaatagcttgctaacactagccttggccatcttggagccaccaatattgtaagcggcattgagtttttgaacatttgtgtcctgatcaccgaccatttctgctaatgaatcgcgtggaatgctggtaatgagcgttttcttggtctgcggattgagcgtaacgaccataatggtgtcagaatttcccttatcaatacgaccgtctgccccggtgtcaacacctagtagtaagatgctgagtggcttagtcgtatcgattttagtactgctgtttcccgtatagatcgtcgactggtagcgcgcctgtgcctggcgaataattaagccaatcgccacgaatgcgataacgataatgatgccgaccgcaattaacactggccgtaattttgaagatgctgaatgccgcatgttcaaatcctcccttaattaaaggcgttaagatggttccccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtaacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgtcgaagcacatacgaccaaggacattcaaggaacgttgaaaacggcccgtaaataccacattgcagtgattcgccaagaccaaacaacgagcactgttatcggtgcggacgggttaacggacagtctgattctttcaaccgccaagatgaatcgaatcatcgaaattagcaaggctgattccatcgccgtggttgaacccggcgtcattaacggtgatctggataaagaagcacgcaagcagggtatgttctacgcgccggaccctggttctaagcccatctctggaattggcggtaatgtggcgacaaacgccggcgggatgagcacggtcaagtatggggctactaaggacaatgtcttaggcgttaaggtcgttttagccgatggtcgcgaagttaagttaggcggtcggacgctaaagcaggcctttggttatgatttaacgcaattgatgattggttcggaaggcacgttaggaatcattaccgaagtaatcgttaaactgttgccgattccgctagggacccccgtgatgggcgtcgcctttttcgataatatgacggccttggctaaagcagtcacggcgattcgaatctccggtgtttatccaacgatgctagaggcattggatggcaatacggttgcggcactcgatcgttacgagaagacgcactatgctaagaatagtgcggcgatgttgatctttaagcttgataatggtggtcaggatagtatggcagtcgttaagaagatactggccgaacagcaagccaacgatgttaagattacgaccgagcctaaggaacaggcagcgttagaacaattacggcgtgacatgctgccggcagtttttgctggtcagaatcatattatggaagatatggccgtgccattatcgcaattagccccattaatggactatattcaagaactatccaagcggttagacgtcgaaatctatacggctggacatgctggcgatggtaatgtgcacccgaccttagtgtggccaacgtcggtaaccgaagtgcctgaaaaaatcattattgcgctacaagaaatgtttaagaagacgctggcacttggtgggacgatttcgggtgaacacgcagtcggaatgttgaaaaatcaatggaacaatgccgaattaggcgaagatgttgatatgttgcaacatcagatcaaagcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaatgagttgttggttaatgagtcactaagaatgtgcagtgtggattaaccgatgcgaaggaggccccaagtgatacctaagagtgcgcgaatccgaattgaatttgatgccgaagtactccgcaacgagatttttgatgtgcatgacttcgccagttttcaaagtttctggcagcgatttgagaatttcttggccgatcgcatggtcgttggtcacctgaacgtgttagagggccgcggcctgattccaagtgattttgcagatgttgacggacacttagcttaccaagttggtgaagatgcgcaccaaattgcgtatgaccaaattgcgcgtgagtggaccatcacgatccgttaaggtagattgagagagaatagagtcttatattggagcgatattgattgagcacaacaaattcccaagcaagtgcagataatgatcagcttttgccagcacccccggaacttttgcaagctgttgatcagttgaaagcttattcgttacgttatgaagttgcgatgaagctcgttttagataagttagattatattagtcgagagtatgagcttcgttacggctacgcgttaattgatagcaagcagtcccggatcaagtcgcctgagagcattgttggcaagatgcaacgtaagcatttaccgttaacgttaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccagtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattattagcaggtaattgctaataatcgggcattttggggttttcttgacgcgaatcaagtccatccatgcacatgactggtatcttatatagaagaaagtaattaagaagttagattgcttttgcaattaaagggttcatgttacttttaatatgcaagataatttccaaggcatattgataataattaatttaatgggaatagctagattaattaaactaacaatcgaatagtggggttaaattcagtgttcagccaaatttttgactggttttcctcggtaccaccagtcgttgataaaactggccagttcttccggtgattcatgtagtcctgtttttaaccaataacggacaacaccaacgataccattgagataatactcaaacatgtactctttttcgcgattgccaataccagtgatctcagcttggttatgtgctaagatctcacgcttagttgttgcgataaagctcatcagaaaatcctggtcggttgttaagatgaaggaagtaacggcgtggcgtttcttaaccacctcaaaaattcccgtcagaatggcttgtaaagagtcgggattaagatgtttatcaataacagctagcagttcttccgtggcatcttgttccatcttctgcatgcaatctttgacgtcttcataatgggcgtaaaaggtgccccggttgatatctgcggccttgcagacagcagtgaccgtaatctcatctagcgactgatgttggagtaagttgattagactatcttgaattaggcgttcggtcatttgcgaacgacggttgtttttagtacctaccactgaagttcacctcattatttgaacaatatactattgtttgtttatttaatgacgattttatgaaaattgttggttgaaattacaccggttttcatttaacatgttgttattatttaaacacattgttgattaaatgtcacgatgtcgttttaagaatctgaattagggaagggatataacgtgaaagggagccgtagacgttttacaatccaagcgattgtttggctagttgtgatggtagcggccatcatcttcctgccaaatatcagcagtctggtacgtgataagggccagaccaagttgccaagtagtgctaaaagtcaagtcgcacaagtcattcagaatcattgggggcgtaatcaaaataatacgcgccaagtggtggtggtcttcaataatggtgattcaccgttaacgagtgaccagaagcaagcaatcgatgggacgattcaacgcttcaaagtgcaaaaatcaaaatatcacgtgaaatcaatgacggctgccagtgataatgctgctgccaaaaagcaattgatttcaaaagacaaatccacccaattactacaattaatggttggtaagaaccagaccgtcgcgaacatgaccaagaatattacggctggtgccaaaacggctggggttaagacgtacgtgacggggagtgacatcttaaatgatgacttcactcaggaaacggaagcggggattcagaagactgaaattattaccgttattttcattttcatcgtgttaacgttagtcttccgctcgccgattacgccgttagtttcactgttgtcagttggggtgtcgttcattatctcgctgagcgttgtgatgaacctcgttaataaatttaactttccattgtcgaactttacccaagtctttatggtcgtggtcttgttcgggattgggaccgactacaatattctactgttcgatcaattcaaagaagaactcagtcatggcgatagtccggtcgccgcgactgggcgcgcgttaaagattgccggacgaacgatcctatacagtggatcgtcactattgattgggtttagtgccctcgggttagcgaacttctcaatttacaagtcagcggttggggttgccattgcggttgctatcctgttgctcgtcttgttaacgttgaatccattcttcatggcgttattaggaccacggttattctggccaacgaagaagtttgctggcggtagtacgagcaagatgtggcacggcattgcagcgtcatcagttcgttacccaatcatcgccctagtcgttgttttgggtgtctcattaccgtttatcctaacgtacaataatgaattaaactacgatacgttagctgaattaaacgacacgattcctgcgaagaaagggttccaagttgttcaggatcacttctccaaggggacggctgaaccgtcaacgttatatatcaagacggatcatgccttaaacaatgaaaaagatctaaaagtcattgacagcttaacgaagcagttacaaaaagttaagggtgttaaaaccgtggcgtctgtcacccaacccggtggctcacaaatcgatcaattatacgttggcaaccaattaggcaccgtcactagtgggatgaagtctgctagcaaagggctaactaagattggtagtgggttagatagcgccaatagtaaattgaagagtgccgatatggatggtagtgcgaagtcagctaagaagttggcggatggggcggatgaagttgctagcggtgttgtttcatataccgatggcgtctacactgttaacaatggtttgaaccaattgaatagtaagaccgggactttgtctagtggtgttaatcagttggtcagtggttcagggcaagttactagtggtgctaaaactgtagcatcagggaactcgactttggcaactaatttagttacttacacaaatggtgtctatacagttaacagtgggcttaatcagctaaatagcaagactggaaccttatctagtggtgttaataaattggcgactggggctaattcactatccagtggattaacaaccgtattctcaggtactcaaagtttatcaaatgggctgtcagagttgaacaataagaaaacttcaatttctagtgggacaactcagttaacaacgtcaatttccgcgttacaacaaggttcagctactttatctgaaaacctagctgctttggaaaaagaagtaagtagtggtaatagtgctatagataccagtgaattacaaacattaactgatcaattaaagaagatcaatactaatttacaaactgtagctgatagtcctaataatgtctcaactaatattagtagtgtggagaaagctgctagtgcattttcagcgtccaacgaagatatttcaaatgatatggtaacaatgaagagtgccttatcaagtgcggcaagtcgggacgctgcttcaagttcaacaacggctagtgtgaatgcaaactcagttgcttctgctgcactggcggcagctggttcatcggcaacgtcagagcaaaaagctgctatcagttcagcggttacttctgaagtaaatgctcaaaatagttcgaatgccagtacaagttcaactgcaacgaccaatgcgggcacagtaacagcgagtgatggtctgacagcattggcagatatgcaacagaagctttcgactttgaaagaggcatctagttctctggatgatttaagtagtaatctaaataacttagcaagtgtacaacaggttgcttctgctgctatcaaaggaaaccaggcttcattgcaagccattcaacaaatttcacaagcagccgcgaaaatgcaacagatggaagcagctgttgcaaagttatcaagtggttcttcagagcttacgaataacttgtcgaaactccaaacaggggctaacacccttgcaactagccttaatcaatatacagcaggagttgcgacagcctctgcaggtgcgtctaagctcaatactggtgtaagcagtgcttcaactggtgcaagtcaactttccagtggattaggctcattacaaggtcaaattccaactttgactagtgcgattagtgcactagatgccgggacgaataagcttactaacaattctgctgcgttagtttcaggtgcaaaccagttagcatctggtgcaaatcaagttgcttccggttcatctcaagtaacaactggcttaactaccttgaaaggccaagtaccaacgttagttagtgcaattagcgcgttagatgctgggacgaacaagttagttgctaattctgcaacccttaacagtggtgcctcgcaagtggcctctggtaatgaacaaatgtacaccagtattcaaagcttagtaggtcagatgcagacgctccaagatggtttgaagactgccagcgacggaactaagacaatcaacactggtgttggctcagctaacagttacttgactggcttaaaggattccgcggctgcgaagacgtattacgtgccaaagagcactttgaagggtaagacttacaagtctgctttgaaggcttatatgtctggtaacaaccacgcaacgaagttaacaatcgtcttgaatgaaaatccaagttcgaagtcagcgatggataaagtaacggcaattcaaaagcaagcgacgaatagcttgaagggaactgcgttagatggtgccaccattgcgattggtggtcaaacgtctgaaacgaacgatacccaagcaattgcttctagtgacttcgttcggaccgctgcaattatgttggtcggaatcctaattgccttgatggttatcacgcgttctgtcttacaaccgttctacatcttagggactttgttattggcttacattatgtccttgagtattacacggatcttgagcaactggttcttgggtcaaagcatgttaacttggaacacaccgttcttcgggttcatcatgttgattgcgcttggggtcgactacagtatcttcttgatgatgaagtatcgtgaatttgataattcggctgcgacaccaagtactcgaattgtcagagcttccgccgtcattggagccgtggtcttatccgctgccttgatcttgagtgggacgttcgccgccttgatgccatccggtgtcttgacgttgattcaagtggcgatggttgtgattatcgggttgattatcctggtattcgctatcccaacgattattccaagtttgattcgcttaacttatccgttgacggatcgtatggaagacgaaaccactgctgaaaagcagacgaaacgaaatcggcaataaaataagtcagttatgcgataataagtgtaaccaactggcgccgtctaacgattcaagttggacggcgctttttttaggggctacacttagattttaaaaacagtgttagttttagtctaagagtatgcggcgagtatgagatagccggattggatagtggcgataaggagatgtttttaatgcaacgatgtgcatgggcggattcatcaccagcaatgcaagcgtatcatgacaacgaatgggggcggccgcaacataatcagcaacgactttttgaactgttgtgcttggagacttatcaagcaggactgagctggcagaccgtcctgaataagcgggcggcttttaatgaagattttgcggattacgatgttgaccaggtggccgctatgacgaccgccgatgttgagcgactactaaccgatgctcgaattattcggcatcgtcagaagttaatggcaacgatcaacaatgctcgtgtgattcgagattggccggccggggaagactttgccacttggttatgggcgtttgttgataaccagcccatacgccaggcgtgggcgtcaatcgatgaggttccagcaacaaacgacttggcgcaacaagtgtctaaagagatgaaacgccgcggcttcaagtttgtcggaccgacaaccatttattcttatcttcaagcgactggtctcattaatgatcatgtggtggactgcccatttgctccagaaaatttaccggcctaacgcgcttaattcctggcgcggtgagtaagtgagccgtcaatttaaaaccagcgcgatgacaactgtcaggcgctggtttttattaaaatcaatatgttttgatataagtgcaattgcttaaattttatgtataaataaatacttattataaccataaaaataattgacatgatgtcgcttaatttgctaagatacggcgtaagaatagctgcggaaggcaagtgatgggagcgacgttaggtgaaagaagtaaggttttggggactcttgttaggactgtttgtctgtttaggggcagtgataccgttagttagtaaggctgacgtacttgatacggcacccgctggactgaatctggaaggcttatttgaaccgggaaagtttgaccgtgattcggccacaatgcagactgttttaaagaatggccattcgcagcatgttatcgaattaacaaatgacgataatcaagttggggcaatgtggtcgacccctgttaatcgctttaacatgcgggtcgataaccaagtctcaatgtgggtgaactttggggacaaagccgtgagtgaaggactggccgttgttttacagaatgatccccacaaaatgagtgcgattagtcggtatggaaagaaaagcattattggtgagaacttgggtgtttatgggacggatacctatacacggcgaacggcgccggccacgattgctaagacggcgattcaaaaaagttgggcgttggagctggataccaaagtgaatgacggtggtttttggggattgtatccccgggggaattctttcgatgaaaagcctaaaaaaatgcatatggccgcgagctaccctgcaagtccggatacttatacgcaacggggtggtttaacgtcctcttatcgttttgaacagaaccatgggagtatcgctgataaattaccactcgcggacggtaactggcaccatcttgtattgaagtgggtcgccagtaaacaaatcatgagttataccctggatcagggaccaacacgaatgaccacaattgatacaacagtctttggaaaggatatccggaatgttacttggggattaactagtacggcgacaaccgctaatgccagaacactggtcgtctttgaccggttgccacaaccgattgaaatcgagtcagatttaaacgtaaccaatctgactcaagagcgaactgtccatgaaggagactgggttcatggtggggatgagttggaatatgagtacgttctgagctatctcaatggtgacaatgaatggcaacaggttaaggccagcctaccattacccgaacaagttcactttagtcacgcgaagatccgctatgcggatggtaccgaggaagagatcaatttaccagcggacgataacgaatcgtcggtggcccgcttacaacacgatttgcagcggacactatcaatgaaaaatccgcacgcttatattacgctgattggtgaggctgccaaggtcgatcgggatacttttgttgatgatgacatgagttactttgagggtcacgagatgaagaccgcaacggccacaccgcacttcaccattacgaccaataagaccgttaagaccgttaacctgacgattgaaccgttgacacaagtgaagaaaggcgagcccgtcatcattaagggccaaattaagctaaatgatgggttagactttgacaatgatggcatgcgtatcgagtacccgggtcaatggtgaagcgggagaagactatcagttgagcatggacgatccggttggttatgtcgaatttgaagtggatgccgaagaactacaaatcggtgaaaatcagattacgttacgggctcatagcaaagataacgcctactcagaaccagtgacagtaacggtcacggtcattggtggggagttacagctgaaaaaagtcagtactgaaagtgtgtttgcaccaatcaagctgacgggaacggctcaagtcagtcggcccgagggacttgaagtagttgtcaatgatgatacgggctcgaaagccgcttggcgcttagaggcgaccgcgacccctctcgtgactaatcagggccgcacactagcgggaaacttgtattatcaggatggtgccaagctgacaatgttgggaaaggatgccgtggaaatcgcgcgccaaaagacggccccagggatcgactatgacgtgaccgcccactggtcatcgcaacaaggtttggtgctcaaaacaacgcccgccgctgttcctggaagttatcagggtacgatcacgtggcacttaagtaccgtaccggaagagtgagtttacgattgtgtaagtaattcgtttaatcaataagttcaatagtcgcgacaagaattaattgctaattcttgtcgcgactatttggtgttcagcgaaagtgctgactaacgcatttaaacgggcctccgatacggtgcaatgctagtagtagcaagcacaaccagcctttcaggggcttagctagcaaattgaaaaatcttcggtttcagacccataaataaacccagcaagttcacaaattagtcagatttcccgtgtaggttaaaagcagtgcaaagcaattgtcataccaatactttatctgaaggagggtttaagcgtgaatttttttaaacgcgcatggctcaatctaacggcaaaaaaaggccgttcaattctattagtacttgttacatcagcaatcatgctgtttgtattggccgggttattgattaggaatgctgccgatacggcaactagtaatgccaagaaaagtgtcggggcgaccgtcactttatctgctaaccgggaggcggcttttaagaagatgcgcagcgccacgtcgacgagtaaaagtagtcggcctaagttgacgacatcgcccgttaaactgagtgatgcgaagaaaatcgccaagcttagcaacgtttcaagttacaatgcgaccgtctcaacttccgctaatgcgaagggctttgatacgatttcaacatcaggtagtagtactggtggtgggatgaaaggtatgggtggctcaagtagcagtggtactggtgatatctcgattactggggtcactaatacgagcagcgtctcaacctttgaaagtagctcaagtaaaattacgaagggccgcggtattacagctagtgatgaaggcactaacaacgttgtcatcgaaagtgaattggctaaggaagatagcctgagcgtcggtgatacgattaagttaaaagcaacgaccggtgataagaagacttacacgatgaagatcgttgggatctataaagcgtcgtctagtgcaagtacgcaacaaggtcctggtagtaccgatgtcagcaacagtgtttacacgtcatacacgttcgctaacacggtcaagggttctaagtacaagaacacagctgattctgtgacttttgcaatctcagaccccgctaaagttagcagcgtcaaaacgtctggcaaacagttgatcaatacgtcgaagtattcgttgtcaacggatgatagcagttaccaaacggttaagagttcgatgaataacgttaaatcatttgcggataagattgtctggctcgttgcgattgctggaacgattatcttagctttaatcgttatcttgatgattcgtgaacgccgttatgaaattggtgtcttgttatcattaggtgagagccgttggaagattgtcgctcaattctttgctgaaatggtgatggtcttgatcgtctcagttgtcttagccggattcggtggtaagtttgttggtaataagctgggtgaccagttagtttcacaacaaacgacgactgcaacgactacgacgagttcaactagtcagcagggtcagcctggtggcggtggcggcgcccctagtggtaacactggtggtagcaagccaagcggcaatatgcctagtggcggcggtcagactggtaatgccagtgccacgaccgacacgaacttagatattaatgtcacggtaatggatttagttgaactcggcggctttggcttagccatcatgttcctgtcgattatgctggcttctggtggcatactacgactacagccgaagaaagttttaattgattaggaggggcggcaatgttaaaagtaaatgatcttggttactggtatgaccgccaagaaaatagtctatttgagaatgtaaaccttgaatttaagtcggggacttcgtatgccattgttggtcaaagtggttccggtaagacgaccttcctctcactgctggcgggtctagataaaccgcgggctgggcagattgaactcaatggtgaaccaatcaataagattggtctgacgaactatcggaagtccaaagtggcaatcgtttttcaatcgtataatttgttgacgtatatgtcaccattgaataatctgatgactgccatggcaattacgaactcgaaacaccgtggtgacaaggattatgcgatgaagatgttacgacggttaggtattacagatgatcagatgaagaagaatgttcaacgcttatctggtggtcagcagcaacgggtggcgattgcacggaccatggtgtgcgatgctaaactagtggttgcggatgaaccaaccggtaatttggatgaagaaaatacgaaatatgtgattgaccaatttcaaaaaattgcgcatgaacaaaagaagtgcgtcattattgtcacgcatgaaccggatgttgcggacgtttgtgaccactcctaccgattagaaaagcacaaatttgtggcggaaacctagggtgatcttacgattgaatcagacgtgagttgacgcgtacaattgcatttttgtcaagataagtcactaaaaatgagttctcagaatgatttgattctggggactcattttttaatgactgtgaattgctaacgagacaacaatcgtttttgagggcgaacttgccagcgaacgataaaggcgatgatgataaacaagacgagatagagcaccgagatgccaatcgcgtaagcaaccggaatactcaacttggccgcggtgtgggtatgcgtggccaaactaacgacgacggatacgtccgataaggcgtgcaagaaaatcggccagactaagttattggttcgtagataaaggccgcaaaaaatcaggccacccgctgcagcataaaagacttgtgggatgacgtagctgagggtcagctggctgctgttaatgagtaggtgggtaagaccaaatagtaaactgtcgatacaaatggctagcatgagtcggtgagggaagcattgtcgtagtagtggcaggagcatgccccgatagatatattcctcagtgatcccgataactagggcgtagccaatatagagaattaacgttggggtccaagcaagatgacatagcttgatgaagttgctcgtcattggtagtaataaaataatgattcccgggatgagctgcaagcattgtcgtacgagtgattgcgattgccaccactgaatcgatattttaaaccaaaaatgatttaatagcaggaaaataagtaatacaagcaagtcttggaccagcccactgtataaagttggtactggtagccaggcaattaatttaaaaagaattggtactaaaatgaaaatactaatagcggctccccagccgcgtttggttgatgacatcgaaatcccctccagaagttaatgctaactttagtataggtcacattgaaggtgttggttatattaattacggatcgattagttgccggtggtcattatgacagccactggtgattttggcgtagaatcggcagtattaataggataatgaccgcgatttcgatgatttgaaaactagtcgtcgttataccgggcaaattgattggaggttccatcatgctaaagaagtcattgacggtgtgaatcaacaatggccatagtagcgatgttgtctgtgccgtgattaaacataatagtagccccagtacgaacgtaaagcccaattgcaatagggttaaactaagtgtttggtgaccaagattgattagatgggtcaaactgaagaggatactagtgaagactgcagctctacctacacccaatgttgactggctggcctgaaacaacattcggcgaaaaaaggtctcttcgaacaggctgatcaatatggcaacgaataacagggtcagggtgtttgtcagttgttgggcggttgctaacgtatataatccaattagtgcggctacgattaaggttggaatgatgggctggatttgccgacgccaagttgccgataccccaaattttaaggtttgccgtagccagtcacgatttaatatgagtgcaattgctaaaaagaacagctcttcgaccccagttgttaatgaggatgggagttgggttaagcgtggtagctggaaaatcaggccaatcaacaacatactgcctaacatgccaccccatagtgtgatgactaatttggtttcgtggcgcatctcctcagatccttcctcgtattctcgctactaagcatacgccttttaaatgaatctgagcataaaaaaaaagcgtaacgacaattaatgtcattacgctgttcgttagtaatcagttattttataaagcccaagcagccatgccttgtgcgttgtataagctaacggcagcattaacttggtcttcaacagagccactgctgatgtgcatgttttggaataaaccataggcaccagaagtactgttcttgaccgttgagttccagtttgattcacgcgtgatgatcgtgttccaagttgaagctgaaacgccagtccgtgattgcatttggcttaatacgtagctctttaagttactaccagtgtagcttgaagtcgttgaggttgttgaagctgttgatgatgcagctgagctagtagcacttgatgaagcttgactagtggttgcagcagaacttgaagcttgactagcagctgattgcgttgagcttgctgaagaagcagcactcgttgcaacacttgaagtagcttggctagcagctgaagaagtagcagcagaactagtagcttggctagcaactgattgtgaagaagcactagtagcactggcactcgttgcagttgaagcagctgaagaagtagcttggctagttgctgattgtggtgcagcacttgtagcagcagaagtcgtggttgttgtagtagtaccattgacttcaagcttatcaccaatgaagattaagttaacattagctaacttgtttgccttttcaatggctgaaactgaagtgttgtgagcttgggcaattgctgaaacagtatcgccggccttaacagtataagtatcagcgttggcaaccgttgttgagatagcgaataaagctaatgcagcagttgatgataatacaaggtttttgatcttcataataattaatacactctcctataatttgcgtgtgttcgattatttacatatattttctattggtcgagcagttgatgtctcaaccaatcaacagtgactagtataactagtgagtgttgcagtgcaataatcagaacattacgtttttaggggttgcttgtaatataaggccgtttttgtaatgaattgtaatatttgagccggatttcatgtaaaatagcgctaccaatcccgattaactagctggaaaatcaataacgacaatgattaagcggggaaactaatgatgaaaattagccgctttatccgataaaagtgatcactttgggtcgatttatgaaaagtcaacgagattatcgataattttaagcacttaactagtgaattttgacgggttaatttgtcgggaggtctgattacagtggcacttaactagtcattttattgcgtggagacgtggtactgactaattatttttcggtaaagcagataattgatagaagttgcgcatcgtgtagtcaattgtggtcggttaacgaaggcgtcgattaattaagtattactatagtaggtttatgccaaaagtagcccatgacgatcgctactaaaacgttactgggttagtattacgccatagctgaatggtatgtggttgtcgttgtggactagtcgtcaaactgtcgggggttcgggactgtacttagtcaggaaattagttggattttctccgttaaggttagtgaattgttaaataaaaacatgtggtattttggttgggagagtgggtcgtcgattggggggacaactagcaggtctggatcgtgtccgtattaaagcggttgccagaataagcatatcgcatatctaaataacgggttgtcagcatgctaagtgctaaggcctattataaagtcacttagcaactgagtaactttataatgggtattggtgggggacacacgtgcttcagcacggatttaatagtagaaaaaaagattgcgaatcagaaatgatccgcaatctttgcatttatttattaatttaaagtggctttttagtaccagccattagcaagccaatgactcttggcgttgctccatgaaccataacgtgaagcaacataactgttagcaacacgttcttggttggcagcggagtagtcaccgtttaagtatgaagcacttaattggtacttaccgatgtattgaccgttacgagcagaatatgaaccaccagattctttaccagcaatccaagccttagcagcactatcagaaccattgttgctatagtttgatgttgaactagacgtttgagtcgtcgtctgagcagcaggtttgctagtttgtgtttgacttgattgggtctggctagcttggctcggttgagcttgagtttgactagtctgagctgatgattgtgtcgtagtcgtttgttgagtcgtctgtgttgaagtcgtggtagtgctatcaccatttacttcaagttgttgaccaactaagatcaagttaacgtcttttaagtggttagcttgttggattgcatcaatcgtcgtgttatgatcagcagcaatggcagaaaccgtgtcaccggctttaacagttaccgtagcagcttgagcggtagcaccaatggcaaagagactagcagtagcggcagcagttgataataaagcattcttaatcttcatttgtaatgtacactcctattttttagtccgaatttggcttggccccgcgaatcttccaagcactcaatggtacctagtataactggcgattgtgacagggaaatagcaggagttttacgaattaccctaattcttgtaataaacggcgtgttttgtaatcttttgtaatataacgcgcggcgcaattgtttctgagcgggtcaatcaaggctgtttacaaatgaagacggtgtctgttggttaacataaccaaatgttgtgattaaagttcgaagcgtgatatcactgggactggcaaccgctgatgtcgtgactaagcttagttaagccaatttacgagttcttttagtggaaatgtaagcgtttgtttgaatgtcagccaacttacttttggtaactcgaaattagtcggcctttaattggaccagccagttgtcggtttgtttattgttaatgagcgattggggtgccgcttgtaggtctttgttaagcttctgaacggtgccactaaagggtgttgacaccagatgcgccccttgatcgtccgtaatcgtgacgagcggatcacctgccacgaggtgctggcccttagttggtaaatcgagttgatgaacgacacctagattgtgttgtccttggtcacttaaccccagtagaagccggtcatgtgatttggtcttcagccaaacgtcgccgtataacatcggagcatgttgctcttcgtaatcatgacgatagaaatggatcatttgtttccaagcagattcttgttttgccatcatttctcctcaattcagtgctagtagtcggtgcatcaattgaaagtggtgcatgattgctaatttcttaattattcctaaccctgggaatttatcaccctcagcgtaggccaatagggtggcaagcgcggcggtgcgattgagtcccgtcaggtgtgcgggtgcccagtcggtgagctttgttaatgcttcaaaaaacttttgcttttgaccacgcatattggcattgctgtccgaaacaaaatgatggatgcgcaggtcaccgttaaccgtaacataaataagatgtaatgcaattgcgcgtgatggcataccgtggtcaaaatagggtcggcccatgagtgagtaatcgccaaaaccatcaaagccaaccggtgtttggtgccagttagcgggggcaaaataggcgtcagttatttcttgatagtccgcaacgtgcgctggggttgccacgggatcagtcaataagaccgcgtgttgtggtaatagttggtgcaaacgcgcttcatcagggattaggacatgaccagcatgctgtaaagtggtcgtatgctgataggccttaagcaacggatagttaggcgcgatgagcaagcttgtttgaccaggagtggttgtcagaaagtcgcgactaaaatcagccgcaagaattgcgcccggccggtaaaatgggtagggacgcagatccggaagtggatggagcttaacggtattaagaccatagacactcacttggggattcgcaataatgctaaatggttgttgggcttcaataaaagtcgtgactgtttgttgtaattctttggagtcacggactggttcaattactgggatgatgtgtgggccaagttggtgttgctcgcacaatgttcttaaggctaacaaatcatacatccgtccacgtagataggggtagtaagtgctcataactggtcacgcagatctggtgccgttagcgcctgatattttagtttgagtgcctgatattcggcattgcgggcatctaattctgtttgtagcgcagtcaccgcgtcattctgggtgtcatcgatgaagcgatcgtacaagttttgttcaggatcataaacgtcgtagccggtgcgggcccgtttgcgtaattctttgaagagttgatcatcagagtagagctgtagtcctttctttacacgcttggctttatcgacctcacgaaagagcgatgtgataaagtgactgataaggggcgtttgctcgacttgtaagtcttggcgttgggctttcttagcgacagttaggaaaccaggcgttcgcaacggttggggtgcgagctctagggcccgctgatcaaaagcacggtagatcaatacaccaatatggtctggaatttccgattgaacttctaggtaaagttgttgcggcaagacaaagtaattgtaatgaccgataaatgaaagtttggcctttgaatgaaaatctgctttggtgactttcaattcgtagcaacgccattcaatctgaccatcggggagttgttgatagcttaatgtatcaacgatccctttatcagcgggcatcgcaacttcttcaaccacgtaggcgccctgttctagacagtactgatagagggtactttcaagttgtttagttaatttagtcttcattaatgagtcacctccatttggtgccaaaagttggcaatcgttgcttcgagctgcgggactgattggatcgtctgatagtactgccaatgtgctggaaataaatctgtgtagcgccgactagcgaagcgttggtctaacaagagaacgattccggtgtccttggcactgcggatcaggcggccagcagcctgtaagacgttgttcatgcctggcagttggtaagcgtaggcgaatcctaagccgttttgatggtcgtagtagtcacgaatcaagttcgtttcggggttgatacccggcagaccgacactgacgatagcgactccaatcaaacggtcgccacgtaagtcaatgccttcggagaagataccacccagtacgcagaaaccgagtaaggtttgcgagggtgctgactgaaactggttcaaaaaggtctgccgggcagttgcatccatcgtcgaggcttgggcggtagttgccacatcagggtaggcggcttcaaaggcagttttgatctgcagcagatagccatacgacggaaagaacacgaggtagttgccacgtttagccgtcaacatggcgtgcaagctggcaataatccggggcacgttatgttcgcgttcgtgatacgttgtctggacgtactgggtgacgagaatggcctgatgctttggtggaaatggtgatggaagctggtaggccaaactgttggcttcaccgccaagcacccgctggtagtaagccatcggggtcagcgtcgcagaaaataggacagcaccactgccgagctctaatgaccgattaagaaagtcactgggatctaggcagagttccttgatcgttaagtgatgaccgtcaaggacgaagcgcgtctggtagctgccatcatataggtcgccaattttaacaaaggtcagacaggcgaagaaatagtcacggacggcgtcgagcagtggccccggcttttgttgcgccaaccagtcagtcacaaattcattaaatgttctgagggtgcgtaataatttgtccgggggatcaggtagcacctgttccgttacttggtcatcaatcaaggttttactgatgcgcgtaaaactacgccggactttcttgagttcgcgttgtaagtcgtcactcggctgacttttatcgggcttggctaattttagcaacgcactgattggctggtcactaacggccgcagagtacatatcacgggagcgactaacaaggttgtggacttcatcgataaggaaaaagttgtcgtcatcacgttcgctaaagaatcgttgtaaatagactaatgggtcaaaaaaatagttgtagtcacaaataatcacatcacagaagagcgacgtgtcgagtgaaaattcaaacggatcgacagtatgcttgcgagcatactgttcaatcacggaacgggtaatctggtcttcatgggtcaacagatccttgagtgctggtttaagtcggtcgtagtagccaatcatataaggattatcttccggaagtacatcttgttcctcgggaaaccgaatctgatccttggcagttagcgtaatgcttttcagtttgagtccgtcatgactcattagcgtgaccgcttcttcagcaacgtggcgcgtactttgcttagcggtcaggtaaaagaggcgctcaatcacgtcttcgcccattgctttgatagccggaaatagcgttgagatcgttttccccgtcccagttggtgcttcgacaaagaggcgtttttgcaaccgaattgtcttataaacagcgccagccaattcatgttggcccggccgaaaagctggaaacggaaatggcaagtcttcaatagaagcgtttcgttgtcgtcgtaaatcggctcgtaatgtcaaccagtattcatattctgtaattaagtcgtggaagaatgcgtctagttcagcccggtgaaggatttgctgggtcttcgtgattttttcattgatgacttgaaagtaggtcagttgcaacgtgacctgctcaagatcgggatgttcttgcagtaacaggtaaccgtagactttgatctgcccccagtaaagtgtcaacgtgttggtacttaagtcctcgaagacttgatcggatgttttgatttcttcaatcaacgccccatcatcatttaactgaatcccgtctgcccgacccgcgataatgtaatcagtatcgttcatcgtcacaatttttttcaggtaaacttcgctatcatagtcttcaccacgactactctggagctgacgatgaatcttagcaccgttcaacgcagtgttctggctattctttacttcatttaaatcgccttgtcgcaagacgaattctaccaattgtcgaattccaatcttagttgccatcggagcatcccttctgaatttagtcgcttcctattataaaacatctgttcgtgtttgtctgctgttgattgatgatgccgggcaaggctctgtgatgtggccttaaatgattgttaagccgcggcagaccagtatttaagacgcgggcttcgacggcttggatctgggctcatcgtgttccagcaattggcggaaatgcctgggagtcaatgtaggacgaactagccagacaggttcacgccattccgaattttttccagcgaatcttagctggtcacttttgcctttgaaaaactgatacgggttaacaatctggattgaaagctaaataaaaaagcatcgcgataagggagccgatgcctgttgcgatgtttagattgacgattttgatttagaagaaaatggatcagactaggaagttaatcgtaccaatggctgtggtgttggcgaatgctcttgcggagactaaaaccgtagctgacgatgctggctgtgataatggtcgctaaaatcgcaagcaaccatgaaccggacgtgctaaagtaggtggcgtaaccaaggctgagactgactaatgtgatgacgggaattagaattctcacaggggctggatgtaagaagacgacaccggctagccacagagccgctgctgtgaccatggcgtcgacactgattggtgaaccaaagctaataccaagagtggtgatagcaagaattgttcccacggtcaggaggaggacgacaaagccgttgctgacggaccaagtaaacgtttttttcatcatgatcgcctcgctttctattaactatattataggctaatttcgccttatgaaagaaataatatgccgacaattaagtttgcaatgttatgaaaattgaaagtttgtgaacaaatccttgaaagcgtatccactattagttaaactggcattaggcacacttgatgatggatggaggaaaaatagtcatggcaaaaattttagcaattaacgccggcagttcaactttaaaatggaagcttttcagtgttcccgaagaaacggtaatcgcatcgggaatggttgatcggctgggattgccagattccgttttcacaattaagaaggcggatggtagtaaatattctgaaactaaggaccgaattgatgcaaaagaagccgctgcaatggtcttaacacggctgaagagcgataatattgtgactcatcttagtgaaatcactggggttggtcatcgggttgttgcgggtggcgaagatttcaaagactctgtcgttattacctcgcaaaccttgaaaaaaatcaaagatttatctgagtatgcgccgctacataatccaacgcaggcttattatattgaagtattccgtgatttattaccaaaagcgactcaagtagccgtgtttgacacttcgctgtatgcggatatgcctaaagttaattacctatatagtattccttacgattattatgagaaatttggcgcgcggaagtatggggcacatggcacaagtcatcgttacgttgctaatcggacggcccaactattggggaaaccattggattcgcttaaattagtgacattacatttagggtcgggtgcttcgatcacggcttttgatcatggtaaagccgtcgacacttcaatgggctttacgccgctagctgggattaccatgagtacccgttccggtgatattgatgcctcaattattccattcttgatgcgccatttagggatctctgatgtggaagactttgttgacattctgaatcataagtcagggttacttggtatttcaggtttgtcacctgatatgcgtgatcttgataagacgcaagatacccgtgaacggtcaaaattagcaattgatatttttgttaaccgggttgtgaagtatgtcggcagctatattgctgaaatgaacgggattgatgcccttgtcttcacggctggtgtgggtgaaaactcatggatgatccgcgaacgtgtcactaaagccttaggatactttggcgtgacagtggatgatgaaaagaatcatatgcacggtaaggaacaaattattagcaaagatgacgaaccggtaacggtcatggttgtcccaactaatgaagagctgatgattgtgcgtgacgttgaacggttatctaaagctgaataaatgagtcaattaaaaacgcgtgattcggattgtggtccgagtcacgcgttttgagttttggattctaatcagcatagcgctaagtcagctcttgtccccgcatatgtgccgatgtgatgtgctcagctattggcgttgtcgcgcaggtttagtcattttgatgtggggcgtgtggttgaatagaaaaggggtaccgctcgaagtgaagccgaaatgctggtaaaatccttgtactggcacttgggcttcaatttgaattggcaaatcagcatagtgttcctgtacgacctgttcgatatgggccattaaatcagcgcccaagtgttgtccgcgttggtttttgtccaccacgacccggccgaaggagagatggtcatcttctgtaaagattcgtgcgtatgcaataatattttgattgacggttttaaagacatgataagcttttaaatcagtatcgtcgacttcctgatagatgcgttgttgttcaacaacaaacgttttgacgcgcaattcataaatagcgtataattcagttgttgttagttctgagaatgttttaatcgaccacatggtgatgcctccttagcatagtgctaagtttatcatcaaatgattgcatatgcaataataaaaaggagcttctatgataccaacattaagattgatgggcacgttgtcgcgaatcgtcacgaacgagggtaatcaacgttttgcgaaatacggcctcaataacaatcagtttatttatttaattcgaatttgtgagcagcctggcctattttttagtcaattggctgaccaaatgaagatggatcgaaccacgaattatcgcgccgttcagaacttaataaaaaaaggttacgtgattaagcagacacatccagagaataaaaaggtccggtgtttgtacccaacgagctctgggcaagcgttgtacccggaattgcatgcttatgagcagtggtgtgcagacttggttggtgagcagttaacgccgggccaacaacaagttttgtttgaaagtctgtcgttagtcacggctaatgtcacccagcatattgagtaagtttaatcactaaactagattaattgtgaacaattaaaatggcgtggcgttttagctgaattttaggcgtgaagagtgtaccatgtagttatcaagttataactggattaatgtgatcaacgcaggttagcacaattgctggacaggcggcattagtcaacagggataatgaaaggggttaataaatcatggcaacaactttggtgttaggtgggggttacgcagggatgcgagccgtcaagtttttacagaagagtctaccaactgaggatgaaatcattcttgttgatcagacaccgacgcatacggagaagactaatttacacgaagtcgcagcggggacgatcgcacctgatcgaattacttatcagattccagatattatcggtaagcgggtccagttcgttcaagcaacggtcaagagcgttgatattgaacaaaaacaagtgacctttgaagatcatcctgaaatgacctatgactacttagtattagcattgggcttccagtcagaaacatttggggtagctggcgccgatgaaaatgccttgccaatggatgatttggcaacttcacaggctgtttatgaacatttggaagaacggtttaaagcctaccgtaccagtaaggacaaaaatgatttgaagattgcggtctgtggtgctgggttcactggaatcgaattattaggtgaactgacccagacgttaccaagattgcaggcgaagtatcaaacacctgctgctaagttagtttgtttggaacggatgccatcaattttaccgatgtttacgcaggaattgcgggactacgctttgaagtttatggaaaagaataatgtcgaaatgcggttaggtgccgttattgaggccatcaaaccgggtgctgtggtttacagtgacgcggacaagaacgaacatgaatttacggctaacactattatttggacggttggtgtcagtggttcacacgtcattgctgattccggttttgatcagcgccgtaaccgggtcgtagttaagcccgacttatcactggaagggcatcccgaagtattcattgttggggatgtcgctgcagtgatggatcccgaaagcaatcggccatatccaaccacagctcaaattgcactggcagctggcgaacaagctgccaagaatattggcgctttgcgtcataaccaagcaacggcgacgttccactatgaatctagtgggaccgtggcctcattgagcgatcgtgacggtattggtgaaatcttcagtagtaacaaaccggttcatggctacgcggcatcagcattgaagaaaattattactgaccgctcacttttggaaagtgcgcatttaggaacggtcttcagtaaagggcgttttgacttatatcattaatcattaaattaattccagtagtatgataaatagccaccacagaaatcgaatttctgtggtggctattttggactagttaaccgtcgaatggctcagctggttgctgattcgggcaattaagtaaccggctgttgggactaacgatactttacgggcaccccttacaattaaggcatgataagggggcggtcaaaatgacgactaaatcaatacgaacaccaattcaaccgtggtttaccctagtggtagcgggcagcttactgataaccttgttttctaccgcactttggtggttggctagcagtgcgttttgcgcgttactcattttaaacttacaatttatcgtctttccaaccaccgcggatcgttattggctaaatcggctcagtttaggattggtactagtgctagtagtgctcgcgaatattaaatttttaatcattagtggcttgacatggcagtaagcgcctagacattaaaggacctgacttgaagcactctgtttcaagtcaggtccttttgtctaatgatgccagtcatttgaatcaagtaggctgatccgattagtgatgcatcttaaattccaaataacggtcattatacaagccgactttggctggtgataaatcttgatagatttgaagatgcttgattgtgttattgtctgggtaaaattggcgatcgttgcgaatggccttaggtaatagcgccttggctttccgattaggtgttgcgtaaccgatatattccgcattttgggcggcgttcttgggttcactcataaagttcaagaaggcgtaaatcgccttaaagtgtttggccgttttaggaatgaccaagttatcaaaccacaagttactcccttcggatgggacaacgtaatgcaagtgtgaattgccagccaacatttcactagcctcaccggaccaatcgaccgcgattgcggcttcgttttggatcatgtacattttaatttcatccgccacgacggccttgacgtttggtgatagccggttaagcttgtttcgcgcagccaatagagtggctggatcggtcgtgttcatagactgattcattgatgcgagggcgaaccccattacgtcgcgggcgctatcaatcagcatgattttgttatggtattttcgttgccacaaatcattccagtgttgaatactgcccggctgaacgtacttgtcgttataaatgataccaagcgttccccagaaatatgggactgagtaacgattgtgttgatcaaaggccaagttcatgaagcgcggatcgtaattcttcattccagtcagtttacttttatcgagcggtaagagtaagtgcgcttttttcattttttcaatcatgtaatcactaggtacggtcagatcgtaactggtgccgccttgcttgattttcgtatacatagcttcgttgctatcgaaagtttcgacgttaacgtgatagccagtctgcttttgaaacttagtgagcaggctggggtcgatgtagtcaccccaagtatataggttcaaaacctttttgccagtactaccagagctcgtctgcaagcgttgcgcgccaaaggccagtaagccacagacgactagtaagctaacgatgatgcttaataattttttcactttcgccgccccctaactgctggccgccggtgccgactactgtattggttaatgaagtagtagccaatcactaacaccagtgccatcaggaacattagaccggacagggcgttgatttccaggttgatgccttgacgggcccgtgagtagatttcaaccgacagcgtgctaaagccgtttccagtcacgaagaaagtgacggcgaagtcatcgagtgagtaggtcagggccatgaagaagccagaaaagatcccgggcatgatgtagggcacgatgacttggctgagtaattgccaattgttggcacctaagtcagccgcggcatccagtaaactggtgctcatttcttgaatttttggtagcaccatcaagaccacgattggaattgaaaaagcaatatggcttaacaagactgagccaaaaccgagcggaattttaagggcagtaaagaaaatcaagaaactggccccgatgatgacgtcgggtgaaaccatcaagatattgttcaacgataacaaagtgttgcgggtaatcggtttggtcatactattgattccgagtgcccccagcgtgccaatgacagttgctaataatgatgataagagcgcaatcaaaatggtgtcgagaaaaatggcaattaaacggctatccgcgaataagtcttggtaatgttgccaggtaaaaccatgaaagttgttcatagtcgtaccttggctgaaggagtaaacgactagaaaaataattggcgcatacagcacgatgaaaacaagccacaggtataagttgcgccacttgaagttacgtaaggtcattatttcgtcaacccctttcgtgcgcgctttttactgctgccagtgagccacatgatgatgaccatcgcaataatcaggacgaccccgatcgtcgaacccatgccccagttcattgtcgtcaagaagtgttcctcaatcgcagtcccgagtgtaatcaccttattgccgccaattaaacgggtcaacatgaagagtgacagtgagggaatgaagacggcttgaatgccagccttcacaccggggagggtcagtgggaaaattacccgattgaaggtctgccaatttgtggcaccgagatcccgactagcattgacgtaagatgggttcagttcgctaatcgagttgtaaatgggcaggaccatgaacggaatctgaatataggccgcgacaaagatgaagctgaaattagtaaagagcaattgcttgggcccgattccgatgaaacttaaaaactggttggcgatgccagcttgactaaaaatgccgatgaaagcgtacgccttaagtaataagttgatccatgttggcataatgattaagagcagccacagctgcggatgcttcgtttcgttgagtaaataagccgtcggataactgatcaataatgttgcgagtgtgatcaagaaggcgtaccagacagagttgagcgtcatcattaagtaggtatttgatgaaaaatacgtttggtagttgcccagtgtaaattgcccgttaatgttgaagaatgattgatagatcaacaataggactggggcaatgacgaagaggatgatccacaacatgtacgggataaagtaagcggtgttacgacttaatcgttgttttggttgcatgttgacacctcctaatcatcttcgtattgttcaagacgagcatcaaaagcagcttcgctctcgtttaaccgcatgacgtgaatgtcttgtgggtcaaaggtcaggccgatcggttcgccttctgcggcagggttagttgaatgaacgagccattcgttatgatcggtatcgtaagcgacgatttcgaaataattgcctcgaaatagttgggagtcgacagtgacgactaatttgccttgatctgcggccacaatgtcgagatcttcaggccgaagaacgacttcgacagcttcattaggctgcattcccgcatcggcgcattcgaattgtttgccgacaaattctacttcaaaatctttgagcattttacccggaataatgttactttcaccgatgaagttcgccacgaaatggttgatcggttcatcgtaaatatcaactggggacccaccttgtaaaatctcgccagcgttcatgacaaagatttcatcactcatggccaaggcttcttcctgatcgtgggtgacaaagagaaaagtgatgcccaggcgttgttgaaggtcccgcaactcatactgcatatccttacgcagtttggcatcgagagccgataacggttcgtcgagtaagaggactttaggctgcataacgagtgcccgggcaatggcaactcgttgttgttgtccaccagagatctcactgatttcacgttccccaagatcggctagttggaccattgcgagtgctttttggacccgcgtctcgatttcatccttgggaactttgtgtaatttcaagccaaatgccacgttttccgcgacattcatgtgtggaaaaagggcgtaatcctgaaagacagtgttgacttgccgctgattggccggcagggtgttgatgacctgaccgtcaaagtaaacttgaccggaagtggcatccgtaaaccccgcaatggtacgcagaatggttgttttaccacacccagacggaccgagtaacgtatagaatttgcccgcttcaagatctaagttgatgttttttaaaacttgatgttccccgtaacttttagtgacatttgtcaatcgaatgattggttgtgtattaaccgccaaagtaaagacctccttaaaacgtgtaccaagctagtgtaacctaataccagctcgattggttgtgacatgattataagtaggacgcggtcgtaaccaaggtgaacgtgcaggacgtggtgccaagattacgaatctgatgcgtcttagtcgcatggaagtacagcgtatctcccgccgtggcagtatattgctgagttccgagctgtaagcttaaagtgccggtttgaaccataataaaggtctctgccggcgacggctcaaaagatttgaagcgaccactaggtgccagtgtgacggtgaccggttctaactgattttcgttagacgcgggtacgagccatttcacacggtatcctaaggcttcatcgtcatacgtggtctgatctgctggatggtagaccactttgtgagtgggctgctcagccgcaaaaaaatcagcgggggcacaaccgagtacttcaagaatcgcgaagaacgtctccattgaaggcgatgactgattgtgctctaactgtgatatgtaccccttgctaaggtcagttcgttcgcctaattcttcttgcgtgagttgcttttgaatccgtaagttgcggatgcgttgaccaatgtccatgacattcacctcgaatcggtagttttgttaaactaaacaataagtttagtacgagctttaattataatgaaaaatgacgtggtgacaagcattttttacaattggcagcttctttttttaagtctgccagcttgtctggtcaaatcgcccagaaacagtggtgttgagggggttggaactgtcgtttggttagtgaataaattaggtgcgttgtggacggactttttgtggcgtgccgctgaagcctgcgcttgctacgccaacgaatcaatgcaaaaatcgcattaatccgctggctaggcaatgctcagcttcaacccgcggcccctcacactctaataaaaaagcccaagacatccgtcttaggccgttagcgttgttgattaatccgcgcggtaaacgacttcaaaaacttcactgaccatcggtgtgtccgatgagaggtttttgccgtgttcttctaacgtcggggtgaattctgccgtcttacgcttgcgccaatcaccaattgtgcgatcaccatcgccttcatggtaagcgtgttctgccgagatgcgataaaacggaatgagttcagacaccaccgttttcagaatcgcgaccggtttcatgtcaccatttagcaagacgttgtagtcgccaacttgtggaatggcaatttgttccgcggtataactgtccagcggcgtggttgtcgctgtcttcgtcccagccagaattgcgtcggctaaagcagtcacttcggcagggttattttgttgaccgaaccaacgtgtttgataagaagccccgtttgtgtcggtgctttcgttataagcatgccataattgttctgctgattgagcgggcataaaggtcacctaatttcgattagaattattgaattcgaatgcatgtaaccgaattcacaattcaagtatagcatgacatttctgaaaacgacacgttcgacactggtttttcggggaaaattaagttagtcaactattgaccgacatttgctataatatacgtacgaattggagggcgaaaatcaatggaaattacacctgttaaaatgctggatttaccacaaatcatggcgatcgaaaaatctggtttttcagaagcagaggctggcagcgaggctgcttatcgcgaacgcattgagaaattagcggatacttttctggtcgcccgcgatggtgcagtcgtacttggctttatcgtgggaccagctgtcggtgcccgctatattgaagatgagatgtttgtagagacaccgactaacttgccacgtggcggccatcagctggttttcacgttggcagtttcgccactagcacgtcaccaacagatcggtagtcaattattgaccgcgctagctgagaaggctcaagcagacgggcggacaagcatggcgttgacttgtttggaacgactaattccgttttatgaacgtaatggttttattaatcaaggtgtggcgaactccgaacatgctggtgaaacttggtataatttagagaaagtctgggattaaatcatgaaattagcaacattacaagcacaattaccggattttgagatccgattactaactttagctgaccaggaagcattgctaaagctggaacaaagtaatccgcgctatcaccaatatttctcaccggaaccactaacgatgactgaggtacaacatgatttgacggcccacccggacgagctagcggcggcacaaaaacaggtttttggtttttacttagcacaccgtttagtagccgttttagatgtactcaatcagtatccacaagaacaatttttattcgttggattactcatggtcaataaggcttaccaacgtaaatcagtgggccgagttattgtaaccggactgatgcaagcggcacttcaagcgaatataacggcgatccaactaacgcgcgttactgctgatgaaggggtcgcaagattctggcagaaactcgggtttgaagatggtaaccagttgttcttacctttaaaagccggtggccggttagcggtgacgacgatgacacggctactccaatagaattctcatggaactcttagcaataaggcctagtaagcgatatcagacatgttaaactcgtgatgactaataaatagaaatgaggttaacacgatgattaagcattggggaaaagccgaaactggcatgttgattgcagccgtattgttattaatggtaatttttaccttctttgaaattacggctagtttaacagttagtgtcattgcttttccgattagtttgattgtgttgatggcgattatggaattcgccgcaacggaattacggcgcaagtaagtgactcgcaaatagatcgtaacctaatatcgtgcttgtttagcaggagcacgtatatatagaagcccgtatttaccacgattggcagatacgggcttttttcgtgacggctgaggactattcctactaggtctaaaggacactgtttggactgtacaagtggcctgattttaacgttttcttagcttgtttataactgtactatactgtactatttaacgtaagcgaagtaacgactgtgtattaaatggaggtgggccatgcaaattgatcatggaagccgacaaccgtattacgctcagatagtaaccggtattgaacaagatattgctcatggtgtgttacaaagtggtgaacaactgccgtcggtgcgtgaaatggctcgtcaacacttgctgaatccgaatacggtcagtaaagcctataagcgactggagacacagcaaattatcgagacggttccgggaaaaggcacgtacgttaaagtggtggattcaacgctgttccgacaagaattacgggaacagtttacacaaattgtcaggctagcgggtcaaagaggcgtcagtattgctgaattgcatggctggcttgatcaaatgggggaaaaataatgagtttagtgattaatcagttaagtaagcgtattgaccatcaccagacgttagatggcattagttttgagattggacttggtcaaattgtcggtgttgttggccgtaacggggttgggaaaacaaccctttttcggacaatcaatgggcagtacctcacggatcatggtcaggtcctggttgatgggcaagaggttgttgatcaaccggaaatgcggacgcaactgtgttttattgatccactggcaaatttttttaaaggcgcgacgattgcgcaaatccagtggtattatcaagctgcttacccggactttgataatgccaaatttgcgcaattgttagaccgttatcatctgacgtccaaacaaaaattacgccatttctctaagggaatgtttggtttgtttacaatcattctcagtgttgcgacgcaagcgccgtatctctttttggatgagccgctagatggtttggatgtcctaattcgaaaaaacattcttggtattctaattgatgaagtggctacgggaaaccgttcaatcgtgattgcgtcacataatttggctgaattagagggggttattgaccgcgcgttgatgcttaaacacggtcgcattgtcaatgactatcaattagaagccatgcgacgaagtgcacgaaaagttcaattagtgtatcgtgacaagcagattccagccgttgttaaacaattaggccatattgtacacgtttctggtcgggttatcgtggtagtgtttgaagattataatgctgaggtccaggcacaattagcgacaactaacccggtatttcaagaagatttaccactctcattagcagacttgtttatggctaatctgacggatgaagctgactttgaattattatcttagggggacgataaaatgacgaaacgaaagttatggcagttgttatggcgccactatcgcacgttgttattaacggcgggcggtgtcttactactagtaggcataaaggaaggctacagtattgcccataatccgtcacggtatgttgaacaaaatgtcagtagttttgcgttgatggaagccactcatcttcggatggaaacggtggtcgccatcatcgttagtctggtgctaggagtcgcactattcttaagcgataatttcacgaattttaatcaatatttatttagtttgccggtcgctcgaaagcaaatttatcggcgtaagatcgggttacttattgggatgttggtcagcgcatacatgttggcggaagctgtttttggactgattgcttggcgcgtgttggctaaacagcaggtgcggattgattggcttacgacattgtatgaagaacttggaatcctggcagtaatgttagtgtttggattattagccgctacgttcgggttatgggttggccatatctttgcgagtgcgcttgcgacatttgtcttcgtttgtagcttgccctttgcatatgatggcttgatcaatcttgctgcaggattaacgaagcttaaatatgagcaggtggatgttttaggtcagctgccgagctggaaacccgggggcttactaaccacttgggtgatttgtggtgttatcggtggcggcctgtatttgcttaaccgctgggcgtttgagcatttatctttggaaaatagtggggattttttccgctttccgcagtggcgcggagccgtcctgggcttttcaattatttatctaattgttgcaatttgctgttcacaatttggtaacggtgttttagggttgctaacggataactatcatgcgcatatgccattatcgactgggattataatggcgctggtcgttgcctatctaacttggagtttggggcggtggtttctgtaccgaccggatcgttttcgcgatgcgtggacggttaagaagttggcttaacttggtcataaatctaaaatgcgcccgttgaagttaagcagactgacttcagcgggcgcatttgttagcggcaattttaaatttattatcctgattgatgaaactttagcgaatcttagttaagcgttttgcaacggtcttaatatttagtagatcccaatcttccaagttgtgtgaaatcgagttatgcccccatgttccacaaccgagtgttaaggatggtgcgacgttatcatatttataaccaatggcaccttgtgaagacggcacgttgatcaatgctcgacaagcagtcatttctaaggcaaacttgttcataacagcttcgtcggtcgtatgcaaggcggccgtatgtcccagtccgccaagtgctaggctgcgtttcatcaggttgaagccggcctcagtatccttggcatgaacgacggcgaggactggtgataacttttctcgtgataagacttggtcaccaccgatgctaggcaactcaactgctaatactttggtatcggatgggacatcaaagccagcccactgagcgatttgccatggcttttgcccagctactttcgggtcaacagcctgtttatccaggttcatgacagttgcttctaaggccttgaagttctcggtaccgacaaagtacacaccgttgtgacttaattcacgtttaacttgatcatagatttgatcagcaacgattaagtttgattcggaagcacagatcatgccgttgtcgaatgacttggaagtgacgacatcactgactgcctgttgaatgtctgcggtttgctcgatgaagcatggcacgttaccagggccaacaccgagtgccggtttaccagttgaatacgcggtcttgaccatgccggcaccgccagttgcaataatggtagcgacgcccggatggttcatcaaggtgttggttgcttcaaggctaggcgtcttgatccactgaatccaatccttaggagcgccagcggcaatagcagcatcgcggatgattcggccagtttcaacacaagatttttgtgcaaagggatggaaaccaaaaataatgggattgcgagtctttaatgctaacatggcattgaaaatgacggttgatgttgggttggtaactggggtgacccccgcaataattccaactggttcagcaactttcatcacgccactgactggatcgtcattaatgataccgaccgtcttgtcatccttgatgtagttataaacgtttttggctgcaaagtcgttcttcgcaactttatcacgataatttccgcgacccgtttcttcgacggccatagcggccagcatgccacgagcagcgtgggcagcgcgggccatggcagcgacagcctgatcaacttgactttggtccatgacttcaagacggttggcagctaacgaagcatttaagactaaccgatcgattgaacgtgatacggttgtttcttccatttctttcagcattcacggttcctcctatgcaaaatcaacttgtttcttatttaacaatcactattataagtactttttcacaaatgtaaatagctaatatttaatttcataaattgcttttgaaacactataattattgatttaatagcgtatataaatgtaaataaactgttcgcttacattttcaccgaacggattgctgttataatattcacaattaattattgattaaattcgaagcaacttttggcttgatctgtaactgattttatataaatggaagggtttacaaacgggcggttgtcaaataagcaagaattgacggggaatcgttggttaataaatatgacaaatcggttatcactcctatgtaaaatgtgctaaaatgaatgtgattcaaaaatcgtatctcttaattaacctaggagggttattttatgtcatttgtaaatgctgttgatatgacacaagacgcatacaagaaccattatgctattggtgcgttcaacacaaacaaccttgaatggactcgttgcatcttgaagggtgctcaagacactaacaccccagttattatccaagtttcaatgggtgctgctaagtacatgggcggctacaagctcgttatggacttagttgctgatgaaatggaaagcatgaacatcactgttcctgttgttatgcacttagaccacggtaactacgaagctgccaaggaatgtatcgaagttggttactcatcagttatgtttgatggccatgacctaccatttgccgaaaacttagaaaagactaaggaaatcgtcaaattagctcatgctaagggcatctctgttgaagccgaagttggttcaattggtggtgaagaagacggtatcatcggtgaaggtgaattggctgatgttgaagaagctaagactttagctgctactggtatcgacatcttagccgctgggattggtaacatccacggcaagtacccagaaaactggactggcttacacttcgatcgtcttcaagaaatctcagaagccgttaagatgccattggtacttcacggtggttctggtattcctaaggaccaaatcgttaaggctgttgaattgggtattagcaaggttaacgttaacaccgaaaaccaagttgcttttgccaatgcaactcgtgcttacatcgaatctggcgcagaccaaatcggtaagggctacgaccctcgtaagttattggcacctggtaagaaggccatcgttgatgttgttacatcacggattggctggttcaagactccagctgttaaataattggatttttgattcagaaaaagtcgactcttcggggtcggcttttttcctgcgcttttttggggaacttggtactgacttaccacctgggagtgccagtgtcagtgtacccttttctggttgctattatcggggaaccgattgtagcgtgatttttaattttgcggtttgttaaaataatcgtaacttaatgggatgctgttggtatccaattgaatgaaggaaaaagtgaggtcagtgattctcgaatgccgagggtcactgacctcattttggtgttaagaacggataactaaacattaatcgcgtcttgcaattgctgctcattgtaaaaaattaatacgataaacatcaccacgtaaagtaataatggtaaccacgcatagttcagggtaatcatatgctgagtggcgatattttgcgcatgattggccgtgtagccgcttagatgaaagagtccggcggtgactaggccaccaagtcctaagccgacattgacgccgaagtcatcagtagaggctaaaataccttctgcttgaatgccaagcgccgtgccataacggatcgtatcagcaatcatgattgagaccaaaccaatgatgagaccgttaccgacagcattgatcaacgtaccaccgaagacgaaggccagttgattgatggctgtcccgagaccaaggatcagttgccccacagcggcgattgcgatacccgccaacatggtattctttttcccgtggtggttggctagccggacaattaaaatgaccccgatcagtgacgcaaacgtaaagccgttaacgactggcactaagtcctcacgctgaatcaagtatttaaagtagtagatggtcgtttgattcttgatggcggttgttaaccaatacagtaaaatcacgctggataaaataaaccacggctggttttgcttgagcatgccccacaccgcactgagtgattggtgcggacgctcaggttgactaaagcgttccttgacttggaagaaggtgttgaggatcagtaccaacgaaataatgccaaatagaacgattgtcagtaaaaaccctcgttgctgatcaccctgaccaaataaagcaactagtggcaaggtgaagacagcgacgataatttgaacgctactaccgaagaattgacgaatcacgcctagtaaggttaattcacgttcattctgggagagtgctggtaaaatcgatgtgattggtaggttgacggcggtatagaagaatcctaaccctaaataggtcacataagcccagacgagtttaccagttgctccgaaattcggggtcacaaaggtcaaaacggcgaacaagacgtagggtaacgcgtaccataagaaaaacgggcggcttttaccgaagcgcgaatgggtatggtcaatcatgacgccgataatcagactttcaacgacatcggctaagcgcgcaacgacaaataaaatcgccgctgcactcgtggataggccgtaaacatcggtatagaagaataataagtatgtggtcatcatctgaaagactaagttatccgcggcatcactgagcccataactaattcgttccggccaagctgtttgccaaggttgtttcaatattaacacctctaagtatggttttgcacaatctaattctaacctagttgcacgcttaaacctaacggaaaggtttacaaaattgattaggtcttagattgatcagaaaaagcctgcaggtggcgttcgtcaacctgcaggctgtgcattgtttgtcctgattaaaagctacttagttgttaatttgctgaccttggtgagtgctgggattaagcccaagctatctaacgtttggtttggtaaaacaacggtgttggcattgccgtccgctaaggctttgacagcttccgtgttttggaagataaagtagttttcggatgattgtgccaaggcttcgtttaagatccgcgtccggtaagcatcagcatctgcttcagtttgaacggctgttgctttcgcctttgcactattcactaaagcttcgttttgggctttattggtggctaataaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacgtttaaaccgtagcccgccgtaacggaggagatctccttgaagagggcggcattgatttcttgcgtcccattcaggacttcgtttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttgattaagatcaacgggtgtctgagccgtgttaacggtgatgacacgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatacctaccataataatttccccctattgttgtggtgcgataatcgttaccgttagaccatgagcactgacggccgtgatttcaacggtatcgccggtgtgcaatggtgttgcggcgtgcaaatggtacaagatgccatagaatgcgacgccgtcagttagatcggtcggtttgataatgaagcgctgaccgattaagcgctgatctaagtatccctcttgcatagatgacccacctttaatgtgataataattaaattatatgctgtttttggttagattgatagggccgttataaaatagtgggtgagttttggattgttgataaagtatggcgataaatggtgaattcatgctgcatatcgctcagtaactatttggataagctcgttttagagggcggttcagtaatacggagttaaaggagcgcttgaagtatttaagccgacaaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacgggtttcattactttggaggagtaaatgaaaagaatgttaattattatagtagcaatcttggagggggatccttaattgctatagatacatattaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttgggaagaaggcgaccgttgatggttcaacgatgattgcccgcaatgatgatacgtttatgccgattacaccgcaaaaatttatcgtccatcccgccgttcatggtcgcaacgaaacgttaacttctgggaagaatggctttaccgcaccacttccagcggatggctaccgttaccaagctgtaccaaacattgaagtcgctgaaaagggtgtttttgaagaaaatggctttaacgaaaaaaacgttggtgtttcttcaactgaaagtgtttatggtaatgaacatacgctgacttttgacccattcgtgcctaatggtctcgcagaagattcattgccaaccatgctcacgccgttcattgattctgctcgtggtggggttgaatacttgggccagttgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgattttgatgatcccgataactttatgtggtctgatggtattcaagaatttgttgcggaacaccatttgaaccctgacaaggaaggttttaacttccgtcatatcttcggtactgataatgaaaaagaccggcattataatactccccgggtctggtacggccaacgttatttcaatccagagatcgaacaagatccacagtcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaagtgcggaatgacgtaccagcagaacaaagcgcgattatgtggatgacatttggggtaccagcttttgcgccatacctcccattccatgcgaacgtttctgaaactgatcctagttttgcgaacacaccactaaaacatgatatgaatagtgcttactggctctaccggacactatcaatgattgttgaatcacactatgctgatttcgttcaggatgatattgattatttgaaagaatgtcgaatcgaactgggtcaatttgtggctgcgaccgatgaacaagcggcgaagttatctggtgacgagttaacggctttcttgactgaacaagataaagtaatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaggttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgacttactgacagccgatacgccaagaccagaagcacgtcaatatcacgttgaaaagcgtattccaaaagaatagttcaatcatcccatgatcagtaaaaagggtcatgggattttttattttctaaacagtaacccatgatgttgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgtcccgattgtgttgcagaatatgggcatctttttagccgccgagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataactcgggcgatgacaagtggttattggtggctagaagttggcattgtctggttggctggtatcttatttgttgatgtaatcggtgctagttggctagctgttcagtctcatatgactttgacggccgccttgctgtcgaacgtggcctttcttcctggtgacatcattaaagggactttggccgtatttattgcccggcgtgtgcgggccatcgttgattttggattgccagcttagtaaatagctaatgtgattggcaggtcaggaggtcataatgacaactaaagaacaagtcttaacaattttattgcgtcatcatggtgagtggcaatcgggggaccagcttgcccaatcagttggctgtagtcgtgagagcatttggaaggcaatcaatgctttgagaaagcaaggacaccagattgagagtcgtaaaaaccggggctactgttatctgggaagtcgtaatttggatgccaaagccattcaaatctatgggcaacgtcaatttacggggccccttgaagtggtcgcccagacgccgtccactcagattctagctaagagctttttaagtcatcatcagccacagtttgccgccttcttcgcggacgaacagacggctggctatggccgtttgggccgggacttctattcaccggccaaaactggactgtattttagcttggttgttcctaatcccacgaatgcattggtcaatgtgggtttactgacaactggtgtcgcggtgagtgtcttgaatgttttacagcaattttatcctaataagaactttgggttgaaatgggtcaatgatatttatcttgatcagtataaggtcgggggcattatcacggaagcaagtttggaattagaatcgacttccgcaacgtcctttattgtcggtgtggggctcaatttaacgaccaccgattttccacgggaattgcaagcccgtgcccaagcggtcgacccgagcatgtcagtggatcgcaatcggttagcagcggccttattatcagcactagtagcgctatcaaaacgctacgctacggccgactttttgccagcatatcgggctaaatcattagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatatcgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgacaaggtttactttctaatcgatgagagagaagtacagtccaagtgtcagtaaaagtgaggatggtgctagtttattcaatctaatttaatattaataaaagtcttgacataatctaaccaaaaactcataatgtgaaatatcatgagagatgagtatcaatggtgagctgataacagagagtcgtcaagtgctgaaagatgacccagcaagcgttgagaagatggtctttcctaatgaacgatcggtgagcagtgatgttaagtggtcgcggttaatgcccgttagcgcagcagttagttctgcatgagttggtgtccaaatgggtgctattaaggtggtaccgcggcgaaagtcgtccttgttataagttataacagggacgactttttgtcatgtaaaaaagtgagaaacggggtatggaagatgagaagaaatacaaagtggttgttagctttaggtggcattattgttgttttggtggctatcgtggggttcagccgtgccagtagttcacaagcaagtcagggtaagctgacaacggtcaagattggggttgctccggggccttatggtgatatggcgactaaagttatcggcccattacttgagaaaaaggggtataaagttgttacaaaggaattcaacgactacgttcaaccgaataaggcactgaattctggggaaattgatgctaatttatttcaacatacgttgtatctgaagaccttcgctaaagctaatcacttgaagttatcggccattggcgagacgcccacgctggggatggggatttactcgaagaagatcacggcactatcagatttgaagtccggtgatacagtctcgctaccgaatgatccgtccaacttagctcgagcactacaactcttagcggcgcaaaaactaattactttgaagaaaaatatcaacgtcgcaacggctagtacggcggatattgtgactaatccgcaccagttgaagatcaagaccttggatgcagcccagttaccacagtcgatgagtaacgtgacgattgctttgattcccggtaattattcctggaatgctaagttgaaaccatcgaaagcgctggcacttgaaaagctcaaggaagattacaaagaagtctttgttgtcaagacgagtcaacgcaattctaagttcggcaaagctgtcaaagcggttctcaaaagtgctgcttttaagcaggcgattgcaaagtcggaatttaaggatttcgataaaccagcttcatggcaataggaggtcaagggcatgagtcagattgaattaaaacatattgatgtgatgtttcagcagaagaagcggacggtgcacgctgttaaggatgtctcactaaccatcgagaaaggtgaaatctttggaatcgtggggttgtcgggggcaggtaagtcaactttagtccgaacaatcaattatttgcaggcaccgagtcagggacaagtgatcgtagatggtcatgatttgaccaaagctaatgcgcgtcagattgcgtccgtgcggcgtaaaattggcttcatctttcaaaatttcaacctgatcggtaatcgaacggttgcacagaacctggcgtttgccctgacagcgggcggctatcctgaaaaagcgcagcctgcgcgtattcaagatttgctaacgttagtgggacttgcagatcgtcaagacaattacccggcacagttatctggcggtcaaaaacaacgcgttggtattgcacgggcgctcgccaatgatccggatgtcttattgtgtgatgaagcgaccagtgcgttagatgttgaaacagccgaagaaatcattcagattctgaaagacatcaaccggcgacttcatattacgatcgtctttattacccatcaattggaagtggccagaagcttgtttgaccgggtcgctgtcatggaggcgggccaattagtggagcaatcgagcacgtatgacctgttcgcagcgccccagtccgatatggggcaacggcttgtcaaccggttcctagatacacaactgccgacaagagtcgctgcacagctcgcacgcgcagatggtcagttattagcattacgttatcgtggtagtgattcactaaccccgattattactgaaatcgccaaggcaacggatattgatattaacattattcagggacggatcgagtttattcaagaacgggccattggggtattagccgtttatttgacgggtaccactcaggccgttaagcaagcgattgcgctatttcagcgacgcgtcgattatgtggaggaggtgcaagtaaatgaatgaaacttggactatattacagcaaaatctcggaacagcattgtgggacacggctaaaatggtctttatctcaggctttatcggaatcgtctttggtaccattattggattaggactgtattactattctaatccgctatttgccccgcacccgcttatcaacagtgtggccggttttattattaacgcgatccgctcgctgccatttttgattttaatggttgtcttgattccgttcgccaaattagtggctggtgatccctatacaccacttggtggcgcagtatcattgtcggtagccgctattccattctttgcccggctagccgaaggggcctttgccgaaatcgatgcgggcgttgttgaagcagcacgctcaactggtgcgagcttctggctgacttttcaggaagtcctatttcccgaagcattgccggcactcatccgtggcgttgttttgaccttgatcagtttgctaggctattcggccatggtcggaacgattggtgctggtggaattggggacttagcgattcaatacggctataaccgttataataccggtgtattagtcagtgtgattgtcattttaattgtgattgtgcaaattgttcagtggtgcggtgatcgacttgcggatcattacacacgttcatagtcaggaaaggaagcataaacatgaagtatacggtattaggtgcgggagccatgggattacgttatggtgttttattacaagcagctggctatcaagttgattttgtcgatacttgggatcagcaggtccaaacaattcaacagcagggtggtgtctatgttgctcgtgatggtcaaaaccgccacttggttccgattcgaatcagcactcctgagaattaccatggtcaaccggatgttctgattattttcaccaaacaaatggggttgacagagattttgtcacgatcagcacacttcttcaatgaccagcaatacgtggttaccgctatgaatggtatgggccacattgaaaaaatcaatcaatacttcaagcctgagaaggtgttgggcgggacggccttgattgggacggtcttaaagcaagctggtgatgtcgactttatcggggcggcaaacgctggttcaatgaatattgcaaatcaaacggaacaacctgacgaaatgacccatcaaatcgttgccgaatttactaaagcacacctgaatccgactttgacgacgaactttttaggtaccttattggcaaaggtgatttttaattccgttatcaacacgttgtgcacgatgttccagattcaaatgggcgagtttattcagtcgccagtagctcaaaagttaggccggcaactgattgatgaagcgtttgacgtttgtgaacgggccgggatcacgttactgaatactcgagaagaagagtggcagacgattgaatacgttagtcgagagacgaatccgttgcactttccgtcaatgtatcaagatataacaaaacaccgacccactgaagttgattatatcaatggttatctctatgatttaggggtgcaataccactatgaagctaagacccatgattttttgcggaatcttgttcacttagccgaatttgctgggacgtttgatattacgagcctgaaaccattgacagaagggaagcactaattttgaaatttgaagagtccaaaattttgcagcaattaccaaaacagttttttgcgaatctggtcaaaaaggtcaatgccaaagcggcggccggtgcggatgtgattaatttaggtcaaggcaatcctgaccaacccacccctgagtttgttgttaaagcaatgcagactgcaactgccaatcccgcggatcacaagtattcgttgtttcgaggtttgccgcgattcaaacaagccgcggctgatttttacgaacgcgagtacggtgtgaaattagacccggagactgagattgccgtattgggtggcagtaagattgggttggtcgagttaccctttgccttactaaatccgggcgatacaatgattttacctgaccccggttacccagactatttatctggtattacgttggcacaggtgaagttggctttactacggttaacagcggacaatcatttcttaccggattatcagcaggttgatccacaagtggctgcggcggccaagctgttgtacctgaattacccgaataatcccactggtgctgttgcaacgtcgcagttttttcaagacacggtggattttgcaaatgaacatcagattggtatcgttcatgactttgcttatggtgcaattgggttcgatggtcagcgaccagtgagcttcctacagacatcgggggctaaagacgttggaattgagatgtacacgttatctaagtcctttaacatggcaggttggcgcgttggttttgccgctggtaatgctgacatgattgaagccttaaatttgattcaggatcatctgtttgttagcgtctttccggccattcaagatgcagcgattgcagccttgaacagtgaccaacagacggtccacgaactggttgggctgtatgaacgacgccgtaatcagttctttacggcggcccgcaagattgggtgggagccctacccatcagggggctcattttacgcttggatgccagtccctgaagggtataccagtgaagcatttgccgatttgctgttggataaagcggcggttgcggtggcgccaggaaacggctttggcgcgggtggcgaaggctatgtgcgcgttggcctcttgattgatgaaccgcgcttcacggaagcctgtcagcgaattgcaaaactgcacttattcgatcgttaggatggcctcttagcattaatgatgacagtcagtcacttgcttagcatgattcatataacgggggcgcaactcgttcttgattgctcggaaatattgagctgtaataacggtatcaaaataacgcaactggcattcacatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgttgtgatgtgaacgaggttattgaaagttgcggcttgtcgcaaaattgaatcaaaaagatcagttgtggcgtcaaataaccgttcgttgtttaagacgggttgaacatttaactcatactggcgatttaattcaataaagccacgcatcgtttgtaaatagtcggactgggttgtcaccgattcaattagtgaacggcgacaaagggtgtagcccccaaattggcccgtcatatcgatcagattgagcaggacactatcagcgttcaatgcgttaatgaagccaacaaagaacatgtcagacccatccgctgaccgaattgcaatcagttggtgctcatttaaggcgttgtttagagtatgatcaacgtcgtcaaactcgctgactttgacggttgctcgatgcgcatggatggtcttgacaaaggcgctttccaataagagctcattgccgcaaaactctaatatctgaatagcatccaatggaatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcggtttgggcttgggtgactaactgtgttaggactggccgttgatcgtctaaagctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaattctcaataattgaactcatcgtgtctaacccccttagttaatgttccctcatcatagcactttttgaggtgaagacgccattataagtcattattcagctggtttggtaagtgtgttatgactaggtaagtaaacggatgctcacgtgctattcaggtcgctcatctcattagaagggccttgttctgcaaatttaaaaccgttttcgcttgcacccggacgctgtcaccggcattgagtgcggctgtttggtatgtgtgcaacacaacacggtgctggtcatcgctacataaaaaatagtgttccgatgatgcgttcacagctagtgatcttaaagtgcaattcgatattcaaatgatgattgccaaaataaacgcatacggtttttttaaaacacaacaaatgtaagggctttctttgcttgtgaaataggagtatcggtcaataagtatccattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattacttagtattcggggtcgcgttaaaacgtggcgatccgatgccaggaatcccgtatttaccatggatggttgtcgggattgcaccatggttatacatgaacaaaacgacgctggacgcgtcttctagcatttatcgtcaggttgggttagtttcaaagatgaaattcccagtcaacgtattaccgtcaattaaaatttatggtaacttatatagtttctggacgatgattgcttttggaatcttcctgatgttcgttaatggcatttggccctcagtttcttggattcaatttatctactactttggttgtatgatcgtattaatgtattcacttgggatttttaatgccacggtcagtgttctgattcgtgactggcatatcacgcttcaatctgtattgcggatgctgttctatatgagtggggtgctatttaactttacaacgtctaacttccccgcagtttttgtgcgcctactagaactaaatccgttctactacgtgctcaacggaatgcgggaatcgctgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatatcatttcgggaatcattcctcaaacgactgggacagtggatgtgcacggtgatacgtccattatttcaatcggagccggtttaaagtggaatttgaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactatcggttggtgatgacaccttctatcaaaaatgtgtggataagattatggaattcaagaagcaagggaagactattatctttgtcagccataatttacggcaagtagaattgctttgtgaccgggtcgcttggatgcactttggggatcttttagaagtcggcgagaccaaggaaactgttgatcattaccggaaattttctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcagtcttattcaatagtaagtgacggcggctggttagtggttgcattaaattaacattaatatcgatgggtgattgcgatggcaatcacccattttttgtgtgcattcaagacggctttggttggaataaagtacaatacaacgtcgcacattattcggactgggggccgctgatgcttttattcgaggggacgagcttgggctgaccgtactaccgatttgaaaggaaaatgtctaaacttcaatgcacaatttatgagttggtttcgggttaaattaagcttgattttttgtaatgcttcagcaatctagttatattcgttataagcattagattattttccgtctggaataccatttggtgggttatcttaatactagagcataaagggggtcatatcatggatacgccactattcttaaatgttgtcgcctatgtgctattaatattggtattacaatatatcaaattcaaatttccagacagtacctttatccgtttctttcaaaaatacgggtggtggttaattgggctatgttttgtcgcaatattggtgattttggccggaccgcaatttcagaacccctttaatgcgttagatgtaccggctattggggtcatgttagtattcgggtacttctttattaaggataaaaaagtcgaaacataagtgatgattaaatgagatagcacctcgaacgatgatgtcgtcctgagaggtgctatttttttgcccaaaaatcgatttgagaagtactggtgtttagccgttttaatctagcattaaacgtgaactgggttattcgataacggaggggcataattaaaaaatcagtttggctccttgaaatatatctaaaagatatatatacttaacaacgcgaaagattggtgaatttaatgtatgaattgtttattttaggacagttgatggatcatccgatgacgggctaccagttgcgtaaagcgctggtaaacgtagtcggttcagaattaaccattagttttggcgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaacaagcaaacgcagttaacgtttcaaataaagctgaattttttacatttattaagtcgtgatcagcagcaagtaatcttgttggattttcagcaatttgcacggggacaggtcgcacgcttaacggcgcagcacaaacgggtgatgacgaatacccacatgcttgccgctgatattcaagatgcgttgatggtcaatgagttacaacgggtacgagcccaagcacaattagactggcttgaacgccagttgcacaatggaggggaagttaagggatgaaaacaatgtcgtttgcgactgatccacaaattcaaaagcatcgctggtggatactggttgcggtatgtttatttacgttcatgtcaacgttagatgggagtattgtgaacattgccttgccagtcatgagtaaggatttagcgattccaatgaatcaggcagaatgggtcgtctcaatttatttgattgtgatttgtgcgttattgttattatttggtaaattaggtgatatttacggtaagattcgggtgtttaaaatcgggtccttactattcattattggctcgttattgtcaggattcagtgtggggttgccatttctactcattgcacgcagtattcaagcagtcggaacggcaatgacgatgagtacgaacaacgggattattaccgaagttttcccgtttaaggaacggggccaggcgctaggtatgattggctcattcgttgcattggggagtattgctggccccggtatcggtggtttgatcctagctcatttgagctggggctatattttctggatcaacgttccggtgggaatcttggcgatgattttaggtgcaatgattttgccaaaagacgttacgacgacgcaacaaccattggataagaccggggcggggctattttccgtactcatggttgcactatttgcaggtgtgtttatcgggcaacagattgggttcttgcagccggttatcttagccttatttgcagtggcaattgtgacgctgattatttttgttcgcgtcgagttgcgccatgaaaatccgctgctagcgctacaattatttaagaatgcccgttttagcattagtgtcttatgtgcgttattaatttttattgcgaactttttctttaacgtgattgccccgttttatttagaaaatgctcgggggctagcggcaaactatgcgggctacgccttgatggtattcccaatcgtacaagtggtggtcgccccgattgctgggacgatttctgacaagatcggaccggaattgttaacgttcgtgggattggtcctgatttcaatcagtcaagtgggttacatggttgtggggctagcaacgccactttggttcttcttattattcgtcggattagttggatttggcaatggtatcttcatggcacctaataattcgatcgtgatgagttcagtggcggtcaaagacttgggcgttgctggcgggattaacgcgttggcacgtgaattaggcatgattgttggaatttcggttgccacgaccgtactatattcggcaatgagtcaatcagcggggtataaggttacgtcatacctgccagctcacccggagatctttattgatggtatgcacattgcgttcatggtctcgttagggatttgtttagttgcgacggtcattactggcgggcggttactaaaacatcgacgcacggcacctgccaagtaaacattagcaaatcaaaaaacgtgttgcgagaaatctgagatgatttcttgcgacacgtttttatattcttgcatccttgatgttgctgaaagggggtctggttaaatcaggcttgttttaaagatccagggcataagctcactgaaaaaaactcggattggcgccgttatgacgccaaactcgtcgtttaattccctagttaggctaatcttcagtcttctcccgtctgatttatgcccgcttgtgatactgagcattgatagaaatgccatgcgactgctttctcgaacgcactgaaacctgtgcatattacgcccatgattccgattatcggaatcgttgttgcttatctagcagttgcgctaactgaccacgaaattcatcgctatggtgttggatgttcgtcaagtcgtgactcatttgaacggtgtagtcagcgacttcgccgtgttcgccttgatcgagtccgagttcttcctctcgttcgtcaacgcgcattctgatgactcgtttcaatagtacgataatgacgatgcaaacgatggtagtaaagccaatggtaaagatcgttgctaatagctgtaatccgaataatttaaagccgccaccatagaaaagaccgtttagagaaattgtgttattaacggctttgctagcgaatagcccagtcatgatactgccgaccatgccggaaacgccgtggcatccaaaggcatcgagtgcatcatcgatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacaccgactagggttggtttgcccttggttagcatatcaacgaccatccacgtcatcatggaagtggcggtggcaacggtcgtggttaagaaggcttggatggcgatgtcgttcatggcaagcgccgaaccggcattgaaaccgtaccagccgatccataaaatagcggtccccagcaatacccataagatgttatagtgctgggtcatatccttgccatacttgtggcgggcacctaagaatgctgataagactaaagcagtgataccggcattgatgtggacgacggtaccaccggcgaagtcaatgacgccaagtttagctaataaaccgttatcccaaaccatatgaaccattggatagtagatgaggagtgaccagaagatgatgaaggttaataagaatttaaaacggatacggccgaccaccgcgccaacaaatagtgctggcgtgataatggcaaacatcatttgaaagatgagatataagccgttgggaatctttgtcgcggtaagcgcggtcaagtccacaccatgcaaccaagtggctttgagattaccgacaaagccacctaaatcaccggaaaaagatagtgaataaccgaatgcgagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagtgacgcactctttttttgtgtttaggttaaatattaaacttacaaacgggctttggtgtcattatggaactgttgatgtcaggttttgtgacgcaaaactattgaaaacatgagtggactccttgtaaattcttagtaaaagccggtcaaggttgcttgttggcagaaatgtaggaagtgacttccaagagtggtcgcgattagttcggtaatgaaaataattaggcaatggggggcaagtgattaattatcttaaactaattaggggaattggtaactatagtgcgcgctattgcttaagaaaatgatgatatgaaaggtgaggcgctttcagcaattgaccattactaactagagcagtaaggttatcaccacataaattaaaagacgatgagattattacataacgtcttaataattaaaacgggggttcagcttatgcgaaaatatgcgattattggggtcggccacgttggggcgaccattgcttatacattagtttgtaaaggaattgcggatgagttagtcttgattgatactaatgcggctaaagctcgcgcagagcaattagatttacaagacgctcaagcccgtttagatagtcgaacgattattaaaatcaatgactatcatgaattagacgacacggatattttatttgttactagtggcaacattcacgcgttagaccatgcttccggtaaccgatgggctgaatttgaatatacgaagcaaatcgttcaagatatcgctccgaaagttaaagcaaccaaatttaatggcgtggtcatcgatacaatgaatccgtgcgacgcaattactcactatttccaacgcgcaacgggattatcacgccaacaggtctttgggactgggactttcttggatacggcgcgcatgcaaaaggttgtcgcagaagccttcgactgtgatccaaaaaacattagcgggtatgtttacggtgaacacggcgaatcacaattcagcgcgtggtcaacggttcaggttaacggtattccaattacatccttagttgataagtatgatttggacttagatgcacttgaggcagctgcacgccatggtggctgggcggttcattctggtaaggggtataccagttttgccattgctacttgcgcggttaaattaagtgaagcggtctttgcaaatgctcgcttagcatgcccggtctctgcgtatagtgagacctttgggacgtatgttggtcagccagcaatcattggcaaagatggggtcgagagtgtgacgacgcttgctctgactgctgatgaacaagctaagttccgtaattcagcggacacgattatcgagaaattccacgcctttgatgacgtcttaagcgatcaatcagtaaaaaaacgtcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttcgtgattgtaatcgcgacgattctgggagtaggctgtgccttgcttggtcaatggggccagttcttcggcgtcatcgcagcaacgtttgcgctaatgttgttaaccagtggctgtttgactttttgtcatcgccgcgggtggcaacctggaagcggcatgttgctagcattagtcacggctacagggtatgtactagttattttaggaagctatggttatttactgcacagctaagcgcagcactttgatacgaggaatcgaccgtatcaaagtgctttttgtctgcaatcatttttagcgtgctaattaagttatgtttcaacaatgattacggccatcggtgctcataaaaaaggtcgcgactcatcatcgcggccttcctgggtgcggtattgattgtaaacatcaaagtggggtcaccgcacccaaggtattaatggcagacctagttggatagctttacctaaagcctgccaacaggtaagcggtaacgcagacgcaccgccgcgctatcggctgcactaataccgttatagcgattatcagctaacatgacactgtggcgatcacggctgtgttccaaaccaatagtatgtcctaactcgtgttcagccacgtggacttgatccgtataagaatagtggtagcgtacaaaattacgtgttaacaagtacacttgcgcttttgtgtaataaccattggtataaccggtcgaaaaagtaataccagctaagcgataatactgcccactggtggcattactggtccccaaagtaatttgatgatgagcagtggttcccggcacgaatttaaagtgaccagtcgcattccaggcttggatggccgcttgatagacgtgccgctcgtatgatgatgcttgaatgacgtaggtcacttgagcgtgtggccaacgactccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgctgagataggggcctcatcctagacccggatttgaccaaaaatcgcgtgatttggtgacgattaaagttagttaaataggctatcgcgtgctatgatgaaaacatcttatgatgatggaaggaaattgatatgacgattaaacaggcaattgttcaacaagctttgacgttaataaaaccgcaaatggttgttggttttggtggtggctcgacggttggtgaactggtcaaggaggcggccaaccatgtgaatgatattacggtcgtcactccgtcaccgacgacgcgccagcttgcgaccgtgctcgggtataccgttgtagatactgcatattgtgaccgggtcgatattgcctttgacggttgtgatcagctagatcatcacggtaatgcgctcaaaagtggcggtggaattcatgctaatgagaagattattgccagtttggcggatgaatattggttactaacgatgcaggaccggttagttgatcaatttgatatcaagacgccactagtcttagaagtgctaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaagctcacggacctgaatgttgaattagcaactttggctggcgttgttgaaacgagctattttgatcacttggtgacgaatgcttggttgggcgatgcggccacgaatacggtcaaagcgctattttaagtgtcatcagggacggcagcatgaccttaatgattagcaattgagcgctgaaattcgtttgacacttttttaaaataattctaaactgaaggtgacgtataaaagcgccaccattttttgaatctatgttattttaaatatctaaggggatgtcaacatggcaaaaaaagtctatactgattatttttttgatgaacctgcttacaacacacatgacggtggctatattccactagttacaccgaaagtcgagccacaaccgttagcgattccgccgttattgaagccggaccgccagacggatacggatgattactataccgtcacggcgcaagaaagcgaaacccagtttttacctggtaagaagactaaaacgtggggctataatgcgggcttcctaggccaaaccatcgtctttcgtaatggtaagcagacccatattgacttggaaaataaactccctgaattgacgactttccattggcacggcttgaatgtcccagggccgattaccgatggtggctgccacgcaccggtctatcccggtgaaacgaatcacattgactttaaagtgcatcaaccagctgcgactacgtggttacatgctcatccgtgcccatcgactgcgacgcaggtctggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactacgatccagatggtgttcaagggcatacggcgttagttaacgggacggtcaacccatattttgatgtgacgacgcagcgggtgcggctacgaatcttggatgggtcgaaccggcgcgaatggcgtctgcacttcaatgacgatttggaatttgcacaggtcgcttccgatggtggcattttgccggcaccggtttatatgactaaagtgatgatgacctgtgcggaacgggacgaaattgtcgttgatttcggtcagtatcagccgggcgatgaagtcacgctgatgacggatgatacgccgctatgtcgcttccgaatcaagtcgttcgtaccggatgacaccaaactaccagaacatttagttgatattcctgatgaaaccccaacacctgacttacctgttcgcacaatcacgatggatgggatggatgatgaagtcgcgctggatggtaagaaattcgatatgagtcgcatcgacgctcggcagaaagttggagatgtcgccatttgggaaatccgcaacaccaacagtactgaaaacggcatggttcatccattccacgttcatgggactcagtttagagttttggcacggaatgatggtccagtttatcctaatgaacatgggctgaaggatacggtcggtgtcaaccctggtgaaacggtgcggatcaaggtcaaatttgagctgacaggagtttacatgtatcactgccatatcatcgaacatgaagatggtggtatgatggcccaaattgaatcatatgatccccaacacccacaaacttatcatttaatggatatggacaccttacggaatgcttttgcgaaggaacaaggcatcaagcccgaagatgtttggatgcccggtatgtaagtgtagattaagctaatttggtaatgagatgtgaataaagtccggttgcaaccagcaagttatctgtttggtcgtagccgggctttatcatttaaaagcacctcgaatttaccatgttttaatcatgatttgtgacgaattagctcgtataaagacaagtaagtctgtatttctacagtttaggcgcagtaactggtacaattcaagtaaggaccgaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttatttgtgattccggccgtcgcgagcgccggtgcagccctgtttttcttagcctgtgtgatggttgccgcggtttatggtagtattactgtcagtcgcgcgatcgtcgtgattcaagggctaccggcattaattgcgtttattctgatgtattttgcttagccggttctttgaagtaatgccattatattagtgttaataaaaaacgttgctacgtgattctgtagcaacgtttttggttgtctaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgggtcgtggttgccggtaaattggcggcaatccaatgaatccaggtgaagccacctaccggaattgcatcgtggtcaacgaaagtgaacgccagtgaatgggtgccagctggcacatcactaatgtcaacgggaaacgagatgatggggtggcccttatacgtttgggcaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacgcagatcgcctaagtctgtccggtttttgaatgcttcttgatcttcatagcgttcagggcgaacgacaatccgatcatggtcttcatcatagcccacagaagggccaagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagttcgcgtgcgggtactggtctaaaaatggcttgagatcgttgctgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcgataaaaacaacgtctgcttgccggtgttcttttgccaaccggttgatcaacggagtgggcttttggaagtcttttttgcgcaagacgggatcttcaccagctaagcgcttataaattttgagcatttcattgtgattgacgacgagatagttgtcagtggcctgcaaatcgtttggtgtcaagctaagattgagggcttgtagccgagcaaacgcggcggctaatacggcactcttgccagttcctgcatcaccatgaataacaaagaggctgggctgtttttgctggcgatgggtacggataaaagttaatagttggtgctctaatgattgttgtgccggtgacaacgcagcttgatcatttagcttgaacgttgcggcactgattgtagatgacatattttttcactcccaaacacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtcgctagtcgggaactcgcgcagtcactgcatcttaacccggtgatgattcgcaatattttatcagttctacataagcatgggtatttaacggggacggttggtaaaaatgggggctaccaattagacttggcgttggccgatatgaacctcggcgatctatatgatttaaccatccccccaacaattagctatgcgcgcttcattacgggaccatccaaaacggatgaacaggctgatcaatccccgattgcggccaatattagtgaaacgttgacggatttatttacagtagctgaccgtcaatatcgggcttactatcatcagtttacaatggctgatttacaagccgacctgaaccaccacggtacgtttttacaacacgaacaagattcagaatcttaagtaaaaagcgtcacttgattgaaaaataaggcgattttcgttaataaccttaatttgaaacgggtttgccattcaggattgtcagggctaattatcggtgctatcttagatgtcattatgaaagtggcattgagattgaaaggggccttggcaatgacagcacggttagtgttaattcatgaagttggtcgttatcgagaattatcggaacaacggtactggttagaatccgccgatttttggggtgtcgatgggcgtggcgcgacggtcaatgaggccgtcggtaactttttgaccaacctcgtgcaatattgccgcgactattaccaacgcggcttgtggcaacttgatgatcggttgttacagctagaccacgttgatacagtgttagcgtacgcgcaggcaggtaagtcaccagcaccattatttttgtttaaattagttccggcggatcatgagttggcgtctgcttaaacgaaatattgacgaattcttaaagaagcgttcatacttccaccacactcctgcgctaaactatgcgttataatcaaagcgtaaattaattggagggtgttgtatggaattagataagatttatcagttaatggacaagtttgaacaaagcagtttaactagttttgagtatcgggaccaagattttgaaattcaaatgggtaagaagggacacggcaagacgacggtgaccccgcagccggcgccacttcccaatcagccggtgattgacccaacgccggtcacaccgacaccggtctcaacagttagtaccccagttgttgcggaggcggaaccaaccccagtggcgaccagtacggctagcaatccgacgagcgttgtaacacctgatcctgaaccagaaccagcgccgattgatcctaaggaatgcgtgacggcaccggtcgtaggaatctattacccagcgcattcttcagaagaagcgccatacgttaagttaggcgaccacgttagcgttggtcaacaagtcggcctcattcaagcgatgcagatgatgcggccagtggttgctaagcaagcggggacggtcaaagccttcctagtgaagaatggtgaagaagtcaacttcggtcaaccattgattcaattagtcccagatacgccggatgacatttaatcaggtacggtcagtggttgctgagcgtattaagcactttgagtagcactacgttttgataaaagcgtgacgcaaactaaaaatgaaccacttcaagcgcacatgataattgtgcaagctgaagtggttcattttttagcttaattaatgacgattggtagtggtttatttaggttggtcaatggctgccacggtttctaggaaccacttgttgaaagcagccgcatcaatatcgacacaaacggtcgcgttggttttgccgtcatggtaagcaccacgaatatcgccaacggtctcgccattagcggggccctccgtctggacatcaatccacatcttttcagtcgtgaaggcttctggatgtagtaagtagaagagcgtattgacatcatgcatcgcaacgccagtctggttgcggtcgttgtaatgaccaaagagggcgtggagcatttcgccagttttaccgagggtcggtaactgttcaatcgattcgcgcgttaaaagggccttcatcgtcacgtctaagccgaccatggtaattggaacgccggattggtacatgatttcagccgcgtgcgggtcggtaaagacgttgaactctgcggcgctggtcatattacctttgcctaaggccccacccatcgcaacgatttctttaatgtgtggcattacttcggggtaggtcttaaataagagcgcgatgttggtataggctcccgttggcactaacgtaatcggttgttcagcagccatgatatagtcacgtagcgcttcaacggctgtttctggtaatggtttcgcaaggtcagtcgggaagtcgtaacccggcattcctgaaacaccgtgaattcggacggcatcttcaaacggtttgatcagcggttgggcagccccacccgctacgggaacgtcactgttaaagaagcgcgttagtttgagcgcattcagcgttgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacgggtcatcttaattacgggcgcatcttcggggatcggtaaagcaactgctttgaagttacaagctcaggggaacattgtgtacggagccgcacggcggattgaaaaaatgacggatttagcagcggctggagtgcacgttttaaaagtcgacgtgacggatgaagcgacgttaatcgcggctgtcaagacgattcaggtcgaacaggggcgcattgatgtcctaatcaacaatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcggatcattaatgtttcttcaattgggggtaagatctatcagcctttaagtgcttggtatatggggaccaaacacgcaattgaagggatgagcgattcgttacggatggaagtcgcaccatttggtatagatgttgtcatcgttgaacctggtggaatcaagactgaatgggctggtattgcggaaaaaaagctgttggcagtttccggtgagacagcctatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcgggggtctcattaacggctcgtcagtggttgagtgatcgtcagtttgaccgcatgatgaactcagccgtcaatggtgcggctaagctgtcaaaagttacgcggcgtaaggaccggcgaaccgggagtcggcattatcggcatgggaaaataggatagaataatgttggtattgactcgttataggtattaaaaccttatggaaagttgaataaagtgagtacgcccgtatttttgacgagttattaaatggttacttcaaaaactaatttataatttttgaagtagccattttatgttgttttagtttattcgaattattaattcgatgtgactcttgatgctatgctaagtatgactgctattaccgtttaattagtagccatgtatcgttgaaagaggatagtgaaattactttatttgtaaataatgaagctgtgttatgatgaggtgacgttttatagagctaacatggacactgaaaaaattaacgggtgtaaattataaatagaagtaaaaaagtgccgtgttttcatggtagcagtaaagtgcggtttgttgatctataaggtttgatgatattgaaaggggatagatagtggtgattgtaggaggtttggtaagcatcttaactgttgaaatcagttactgttgttaccttgtcaaacacgcaggcgttactaatttgttgacaatcatactgtccctcggttgtgtaatggcaacgttagggttaaccataatgatgcctgatttgccggaaaaaattggtgttattggcgtcgttattttggctgcaacgatgaattatttaatgttctggcacgaaaaacggactgctcgagaagatgatactcaatttgactggattgatagtggcaaccaacacatgggttttcaacatattattcaaaatcatggtgaagcatttgcagcccaaggagtttcacaaactgctattcctaaactggttgcgaaagctgttaatagctattatcgatctggggggcactttgacaagtggcaaccatatcatcgtgtactattgactattcactatcggtatcgaaagcaccttttagcagtgacgttgtcgcgagaccagtacattattagtgcttatccggcgccgttgttggataaatatccacgggtgaagaaaattcgaattatgttggaatatggttgttatccgatttggttgtatgatgagaagggtaacctaattagtaatgatctgccgcaagtattgcgaaaggacgcaacgcttaataaaaaactattggtgttgcaaaagcaatacgatagtttgtttactaataatcagcatgattttagctacaatggttttgcaactgcggcagatgaacagcagtttttacgtgcattcatggttattcacaaggatttgaagcggcgactaggggggaagtacgcggtcttaaacaaaattacggggaaagtagacaaggtatttccaacagcaacgacggtagcatcgtcgcaagctataccgagtgaggctgaattaaatagtgctatcgttaataaacctaaacctgtagtggataaaaaagcaaagactcatgtgcggacgtatccaggattaaaagctgatctgttgaaggtttatcagaatttcgatatagaaaatttaggccctacgtatgacgctttagtcgatataactaagctttatcgtagaagatttacaaaatataccggtcaagttacgttgaaaacagttcaacaatctactgcgaaagattatattcttggtcatacggacaagaatttatctgagattgttgctaataataaagatatggtggcgaaaaatattggtaatgcggcaatgtgccggcaagtaatgcaattgatagatattatgagtcggtatacattggacgaactatgttttaaatgtcatctggctcgacttcaattgagtacgactaatgcccataagcgattattgaaaacatgccctgattgtggtgctgtctttgtaaataataagttaaccaatattacgataactggtttacctgccaataaattacaagttaagatgtatttaaggaaaacaggcgttgtatcgatggccgcagcaactgagtcaatagacactactatgccaaaacgtaaaataagactatttatggaatggggttcttcctttatttgggtatataacgaggataatgaattgattaaaaatggactcccggatgagctatatcctgattcaggactagtggcgaaggtaaacgttttaaatcgtcagtatagcgagctgtttaccaataatggttatgaatttagatataatggatttaaaacgcatgaagatgagaatgcattcgaacgtgactttaatgcgatttattaagaaatcgctgaaagaactagaggtaagtatcgagttatcaatgaatattatttcacatctaatactgaagatgtgcgggacctgtagttgttggtcaatcattgtggatgaattcaattggaaataagctatatgtagaatttgttgcgagattgtaacagtagttatgaagaaattaattcaactaaataagccgaccgtcaagtatacgatcggcttatttatgtccaaaatgactgacaggaaatgagttcgattttatagcttcgtcatcaccgccgttagcgtagtcgttgcggtggtcatcgcgggatcgcccacggggtggtaggtaatggtgaggttgggaaattcttcgataatgggaatcagcgtttgccattagggtaggtctggttggtcggcttcgggaacgtcccagttgttttgctgccagcttaaataacgttgttcgctaataaccgccgccacttgttcagttgtggtgtgaatatgaacgggtaaatcatgacgtttcaacgtggcgagtgcggtgatcagagcactcaaggctaatgaagtttcggtatgtccgtagccactgtcgtttagcgccttttgatggtcagcatatcgcagaatgacgacccaggcagcgggggtcgttgcggtgatgttggtcgattggtggttggtacttgcaaggtaaagatgaatcgtagccattgttggggcctccttagttgtaatgataatccattgagtggttcatctaatagtttcgtaaaaactagccagcttcattttaaattaatgaataattttaatgtgcaactacaatagttacaaaatttagtgaattggcggtgcgtattactatgatttttggcggattatgctacgattaaatacatggataattaagaagttattaagcaataaaggtgagcactggaggttagcatgcagacattaatacagacgtttatagatcgacgcggggatttgctgactgcgctatggcaacacttggggatttcattagcatcattagtcatcgcaatggtaattgcgattccgttggctatttgggtcgttcgacgaccacggtgggctgagggattgttacagctcacgagtgtcctacagacgattccgtctttggcactgttagggttattgattccgttagttgggattggaacggtgccagcagtaattgcgctggtgatctatgctttactgccgatttttcaaaatacttacttgggtatctcagaaatcgatgcctcaattgaagaggccgccgatgcctttgggatgtcacgaatgcgtaagttgtttaaagttgaactacccattgccctaccacagatcattgctgggattcggaccgcgctcgttttaatcattgggacggctactttggccgctttgattggtgctgggggtctcgggacctttatcatgctcggtattgaccgtaatgatacctcgttattattgattggggccatctcatcagcattgttagcaattctgctgagtgcgctcgttcggtggtttcaaacggctaaaccacgccacgccttaatcgtctttgtcggtattttagctttacttggtggtggcggggcttatagtgtctatgccaatcgagttgaaacaattacgattgcaggtaaacttggttccgaaccagaaatcttgattaatatgtataagcagctgattgaagctgaagatgaacacgttcatgtgacgctcaagcctaactttggcaagaccacgttcttattcagcgcgttaaagaataatcaggttgatatttatcctgaatttactggctcggtgctggagaccttagttaagggaaataacccagctggtcaaacagctaaccagacctatcagctcgccaaacagcgccttgctaagcaggaacaaatgacttacttgaagccgatgcagtataacaatacgtacgcattggcagtgactaagaaatttcaacaagaacatcatttgaagacaatcagcgacttaacgcaagttgaatcgattctgaaacccggaatgaccctagagtttattgatcgtaatgatggcttaaaaggaatcaagaagacttatgggttagacgtgactgccaagtcgatggagccggcgctacgttatgaagccatcagtaaggggaaaatcaacttggtagatgcctatgcgacggatagtgaattacggcagtatcacttggccttattgaaggataacaagcacttcttcccaacgtatcaaggggcaccgttgatgaagacgagctttgccaacaaacatcctaaggtcgttaaagcgttgaataagttagcaggaaagatttcagaaactgatatgcaagaaatgaactatgaagtcaatgttaagaagcagtccgcttcgacggttgcacatcgctatcttgtgaagcacggtttattgaaggagggacgttaaatgacaacggcaattgaatttcaacacgtccagaaagactttaatgggcagaccgtgattcccgaccttaatttaacgattgaccagggtgagctatttgttttggtagggacttctgggagtggcaaaacgacgtcacttaaaatgatcaactgcttagagccactgacggctggtaaaattctagttaatggtactgatacaaccacgataccagtccgaagtctacggtggcaaatggggtatgtcttacagcaaattgccttgttcccaacgatgacggtggcgcaaaatatcgccgtgattccggaaatgaaagggacagctaagaaggaaattaatcaaacgattgatgagctattggcggaagttggcctcgatccaaaggaataccgtgaccggatgccgtcagaattatccggtggtgagcagcaacgcatcggtatcttacgggcgattgcggcgcaaccagatattgttttgatggatgaaccatttagtgcgttagaccccatctcgcggcaacaattgcaagacttggtcttacggctacacgcccgctatcacaacacgatcgtcttcgtgacgcatgatatgaatgaggcgttgaagttgggtgaccggatcggtgtcatgcaacacggtcagttaatacaagtcgatacgccggctgctctggctcagcatccagtgaacgactttgtgcggaacttctttggcgcgagccgagctaaaaatgtctatgatgtctacgttgggcgtgtagggcttattcagggttatctcacagaaaaacccagtgttgcgagtggtcggattcaatcgttagacgttcaagccacgttacgcaccgcctttacggcattgacagatcacgattatgtggcggtcacggaagaaaatcgggttgttggctatttggatcgccaacgaatcgtggcttacttgagtcaacatgaagaagtatcttaatcgtcaattaaggatgaatcagttacactaggttgtgataattgatggtcactaatgaatttaaggaggaatttcgaatggcggaacagtacgatgttgttgtgattggtggcggaccagccggcaatgccatggctagcggattaaaggctcagggcaagacagtgttgatcgttgaagcggatctgtggggcggcacttgtcctaaccgcggttgtgaccctaagaaaatcctgttaagcgccgtcgaagcgcgacaagcggcgcaacatttacaagggcaaggcctgattggcgcgcccaaaattgattggccagcactgatggcgcataaacgaggctatacggatggcatcaacgatgggacgttgaacggactaaaggggcaagatattgcgacgttacatggtcaagcacactttcaatccgacaatcagttagcggtcggggatcgagtagtcagtgcgactgattacgtgattgccactggtcagcgtccggcgattctaccgattaccgggcacgaatactttaagacgagcactgacttcttagatttggaccagatgcctaaacgcgtgacattcgtaggtggtggctacgtaggctttgaattggcgacgattgcgaatgccgctggcgctgatgtgcacgtgattcatcataatgaccgcccgttaaaagcttttgatgcagatttggttaaggatttgatggccgcaatgacggctgatgggattacatttgacttgaatacggatgtccaagcaattactaaaacggcgaccggtctacaattgacagctgataatttcgagctgacaacggatctggtcatcagctcagcgggacggattccgaacgcggaccagttaggcctagccaacgtgggcgttacctttgatcggcatggaattcaagtcaacgatcatttgcagacggctaacccgcacatttatgcgattggggatgtcagcgatacaccggtaccgaagttaacgccagttgcaggttttgaagcgcgttatctggtcggtgagttgacgcatcccggcgcagccataaagtatcccgttgtgccaacgcaggtttttgcagcgcccaagttagcgcaagtcgggatcagcgcggccgcggcgactgagcatccagatgagtatcgtgtcaatacacttgatatgacgaagtggttcacttattaccgctttggcgcacaacaagcccaagctaaagtagtggttgctaaagcgagtgggcaggttgtgggtgctacccttctaagtgatgttgccgacgagatgattaactacttcacgttgttaattgaaaaacacgtgactttaccagatttacaacggttggtattggcttacccaacgccggctagtgacttacaatatttgtattaatgtgtggttgaattaaatcaaagtccagctattcagcttaactgaatatgtcagcactaacggagtgaccaggaatgaccggccactctttttttgtttgaccggcgtttggagtggaatacggaggccaaatgatgtcgcaaacagacggtcgtcattttcgttgtgcgactatcttggcgtgtaagtactgtgaaaaaatgtcaaaattgtagctcgtcgcggtggcactaatgttagtaaattaattattttatagaactagaagcgattgcttaaatgctacgatgcttgctatggcagtatcgaactgtgacatagtacaaactagttttaaagtaaattcaattgtgcaaaatttaatttatgcaaatctattcacaaaacggtcgcgacatggtatgattcaatcatcaattatgatagcgttttcataaaactgttatgactaaggagtgacacaccatgaccgacaagtacattatggcaattgacgaagggacaaccagtacccgcgccattatctttgaccatgcgggccataaagtggccgactcacaacgggaatttccacaatatttcccgcagccgggctgggtcgaacataatgccaatgaaatctggaatgctgtcttgtctactattgcgaatgccttcattgaatcgggaatcaaacccgctcaaattagtggtattgggattacgaatcaacgggaaacaaccatcgtttgggacaagcaaactggcttgccaatctataacgcaatcgtgtggcaatcacggcaaaccgcgccgattgctgagaagctggttaaagatggctatggtgatttgattcatcaacatacgggactcgtcacagacgcttacttctcggcaactaaaattcgttggatcttagaccacgtgaaggggtcccaagaacgagctgaaaagggggaattactctttggaacgatcgatacgtggctcctatggaaacttaccggtggggccacccacgtgacggattattccaatgccagtcggacgatgctcttcaatattcatgatttgaagtgggacgaccagattttgcaattattaaatattccagcggcgatgttgccagaagttcgcactaattctgaagtttatggcaagaccaaggactaccatttctttgggtcggaagttccaattagtgggatggctggtgatcaacaagcggccttgtttggtcaactggcgtttgaaccgggaaccgtgaagaatacttacgggactggggcttttatcgtgatgaacaccggtgaaaaaccccaattatccgataataacctattgaccacgatcggttacggcatcaacggtaaagtgtactacgccttggaagggtcaattttcgttgccggttcagcgattcagtggttgcgtgatgggattcgcctggttgaaagcgctcccgattctgaacgggcggcgcgcgaatcgcataatgaaaatgaagtctatgtggttccggcctttactggtttaggggcaccatattgggactctgaagcacgtggctcagtctttggcttgacgcgtggcacgactcgtgaagattttattaaagcaaccttgcaagcattggcttaccaaacgcgggacgtggttgaaacaatgaagaaagattccggtattgagattccagtattaaaagttgacggtggcgctgctcgtaatgactggttgatgcaatttcaggcggatatcttggatacgcaaattatgcgggctgctaatctggaaacgacagcgcttggtgctgccttcttagccgggcttagcgttggttattggcaggatttggaagaattaaaagcgtcgtataagcccggcacgagttttgaccctgagatggggccagctgaacggacgaacttatacgagggatggcaggcagcggtcaaagcgacccaagtctttaagcacaccccataccacgcaggaaaatagaggaggacaacaacatggcattttcagcaacgacgcgtcaacaaaatattgaacgcttacaaaatgaaacgttagatttactcgttatcggtggtgggattaccggtgccggtgtcgccattcaatcaaccgcaatgaacatgaagaccgggttgatcgatatgcaagactttgcagaaggaacttcatcacggtcgacgaaactggtccatgggggtattcgttacttaaagacgtttgacgtgggggtagtcgccgataccgttaaagaacgggcggtcgtccaggggattgcgccacacattcctaagcccgacccaatgttattgccgatttatgatgagacgggagcgaccttcgacctcttttctgtcaaagtggcgatggatctgtatgataagctcgccgaagttaaagatcctaaattcaccaattataccctttcgcgcgaggaagtcttacaacgggaaccacagctgaaccctaaacatttagttggtggcggtgtttaccttgattttcggaataatgatgcgcgcctagtgattgaaaacattaagaaggctcacgaaaatggtgggattatggcaagtcatgtgaaggcgaccggcctcttacatgatgatgatggccggatcaatggtatcaccgctgaagacttattgactggtgcatcgttcgagattcatgcccgaatcgtcatcaatacgaccggtccatggtcagacacgattcgtaagatggaccatactgaaaagtatcaatcccagatgcggccaaccaagggtgtacatttagtcgttgacgctgagaaactcccagtgccacaaccaacctattttgattctggtgatcaagatggccggatgatcttcgtggtgccacgtgaaaacaagacgtatttcggaacgactgatacggattaccatggtgatctgaaacatccgaccgttacgcaagaagatgttgattacttgttggaaatcgtcaaccgtcgttttccaactgctaaaatcaccttagatgatattgaggctagttgggccggattgcggccactgatcgccgctaacggtagttccgattataacggtggtaattcaggaaaaatcagcgataagagcttcaaggaagttatcaaggttgttgatcagtttgaaagtcaggaagccagtcgtgaagatgtcgaaagtgtcctgaatgacttggaaacttccttggcagaggacaaactcagtccgtcagcggtttcacgcggtagttcgttgactagtagtccagacgggctgttgacccttgctggtgggaagattactgattaccgtaaaatggctgcgggtgccatggcgctgattgccaagattttagcagataagtatgatgcccactttaatgaaatcaattcgaagaacctccccgtttctggtggcgatattgatccgcacaacgtggatgcaacgattgcattttatgctaaacaagggacggataatggtttgacgaatgatgaagcgttgcggattgcaaatatgtacggttccaatgctgcgcgggtctttagtttgattggtaaagttgaaccgacgcatggtctgagcttagccgaaacgattagcttacgttatgctttggatgaagaaatgaccctgacgccagtcgactacttgctgcggcgcactaaccacttgttattcatgcgagatacgctggatggcttaaaggatggcgtcatagcgacaatggccgattaccttggttgggatgctgcaacggtcaaagcacaaaccgaattattgaatcagacgattgctgaatcggacttaacagcactgaagcagggctaaggaatggggtggtcatgatgaaagatccattagcactacaattgttgggggaatttctcgggacctttatcttgattctgttaggtgatggggttgtagctggggtaacgctcaataaatccaaagcgcaaaatgcgggctgggttgcgattaccttaggttggggatttgcagtcacgatgggcgtctatgcgtccagctttatgagccccgcacatcttaatccagcggtctcactaggaatggcagtggccggtaagttcccatgggcctacgtgattccatatagtgcggctcagattgctggtggggtgattggtggcctcgtggtttggttgcactactacccacactggcaagcaactaaggatgctggcgcgattctcggcatttttgcaaccggtcctggtatccggcgatatttctggaactttatcagtgaagtgattggaacgttcgtcctagtctttggcttgttagccttcacgaaaggccaatttacggcgggattgaacccgattgttgtcggaattctgattatcgctatcgggctgtctctgggtggaacgaccgggtatgcaattaacccggcccgggatttaggtccccgcattgcgcacgcggtattgcccatcgccaataaaggaacttctgattgggcctacagttgggtgccaatcgctggaccattggttggtggcgcgttaggcgcactgttgtttaatgtattgccataattttatgactgatttgatataaaccgtgaggactgttggaattgacaacggtcctcacggttttatttgtgagtaatggttgaaattcatgctttcattaactgagtaaaacgtcaatagataagcagactaagacgtcgaataccgtcaccaataccattgacaatcaagcgaccatcacggtacatcattacatgaccgattctactgataaggtcgctcctgatgaaacagtcaaagttggttacgggaaagcttatgatgttactaagcaggtcaaaacgataactggatataagcgtaatgccacattggatgaacatacccgtggcactgctagcaagactaccaaagaagccgtgatgtattatgatccgttgccatacaacattcatgtcaattacttgttaacggatgggcagaagctggacgaattggatgtcactggtctatatggtgatacttacacgaccgaggcaactgatttcgaagatttgtacacagttgatactgatcgcttaccgacgaatgcccagggaacggtaacggaaaagccaacaacggtcaattattattaccaaccaacgactgggcagtgggttgacgttggtaatcaaagtagtgttttagtacgacaagatacgaagcataatgtccgttctgtctcgcagatttatgccaacgatagtggctttacggtcaaatataatcaggatgctgctcaagttgcgattgcggctagtgatacaaacggtacccaagataacagcttagtctttgattataattcaaagtatacgtttgaattatctaagaatgagactgtcacttttaaggttgatgatcaaggccaagtgactgcgactagagtgttaggcgcagagcaaacggtcacgacttttgataaaagtggtcagctcaagacagtgaccacggtgactaacgcgaatggcactaagagccagcagaccaacacggttgacgggttgaaatcaatggtgactggcgaacaatacgacttaggattattgaatgggttgaaagttaccgcacaaaaagaaattaatccgagtcaagcagcaacgactgagtccaagacaacgactgatactagtcagtctggtagtaatcagtcgacaagtacgacagcgactgaccaaactgggactaatgaatcaactgctggtagttcgaccaacgcaacgaacgcgtccagtagtgtcgatgcaagttcagcgaatagtcaaggtgacactgaggctacaagccagtcgggtactagtgcaagtgctgattcaaagacggatagtagtgtggcatcaagcactagtcaaactactgacggtgaaacaaccaataccggtgatacgaccactggaacaactactggcagtgggctgggtttcaagtcaccatttactgaggatcaaaacacaagtagtgcactaggcagcgctcaaacttcgagcagtctcaatagtgatacgagtgcagcggtacaagcattgattgcagaacccaattcgacgccagttgtcttggatgaggatgcttcttttgaggaaggcgtgccagtcaatgatccggtattcagtaatgatgaaggtgtttcgccgaacaataatccaagcagcgcggcgacgccccttgcgcaagccacgaatacccgggcgcgtctgactcaaaatggcaaactattatatgaaggaacgctgaaggctgatcaaggggaacaaaatctctatgtgtcgccagatacaactgtagaagttgatggtggggccgatggtgacggtttttacctagatacttatgatggtgataaaggaatggcctatacattgggttcaggttatgcgtgggcagccgaaaacaatgatgtgactgcggcaccagcaagtagtgcgacgaccagctctgagagtgctgctagtgagccgagcgttaatagtagtgatagtagccgtacagcatcaagtgcagtcgaccattcgactagttcggcaagtaccagtgatgcgagccaatcaagtcattcaactagctcgggtgaaagtagtcatccagaaagttcatcaggctcaagtacgaccagtgattcggctgacgtggataaacaggccgcagctcgttccagccaaactcagtcgaatagtgttaatggtagcagtcaagcagtaagcgctagcacggtcactagtcaatcgtcagtaccaactaaagctaatacgaagcaggcttcatccacgccaacgaccaaggctaaccgagcaactgtcgcagccgctaccagttctacagcgccacggcagtcgcgggctacgacggcaagtgcgtcagttccaagtgtaacctcagcaagtgctgcagcgacaagtcgtgataagcaacgatcggcgttcaagaagcaacatccaatcttgaaccaaattttgcctaaaacgaactccgcggtcgcgacctggttggtctggctaggagtgggtttgttgctactcactgtagcgattacgatggttattaagaaacgagggcgtgactaatatgataaaattatgccaggttcttaaaaaaatcctcattggcctaatggtgtttgttctagttttcacggctttttccagctcggtcgacacagtctccgcacatcgccgtggtgtgacccacactcggaagcataaggtgcgacatagcgctagtggtcacgccaagaagtctcatcgtgcacatcgcaaagctaagcgcagagtcgtccaccgtaaagcaccgcatcggcggaaagttgcggtaaggcataagaaaaaaaacgccaaagcgtcataaaaaggcgcataagaagaatgccgctaagaaacatggcaagtccagtaagaagaagtcttccaagaaacatggcaagtcgcacaagaagaaatcttccaagaagcacggcaagtccaataagaagaaatcttccaagaagcatggtaaatccagtaagaagaaatcatctaagaagcacggcaagtctaacaagaaaaaatcttcgaaaaagcatgcatccaaaggtagtgctgtaattgccacgcttagtcgtaagaccggtatcagtaaaggcatcatttcgcttttgacggatctagttgggtataatgatatttataccatgattacgggaaaagatgccgctaccggtaagaagcgctcgcggttggtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgcccgagcaactaaactggcgacaaagcgagcggccgagaaactagctaaacgaaagcccgccaaaaagactgcgaaaaaggcagctgagaaggctcgtaaagctaaaaaggtcaagactgccaaaaaagctaagcatcaacaggcaaagcccaaaaagacttcccatggcacgaagcataaaacgaccaagaagcagcagaagcgatataacaagaaaaaagctgcgggcaaggctaggaaagcttcgtatgcacggaaaaagggcggtactaaaaagaagccgggcaagcgtaagggtgctaaagctaagactacaaaacgaaaggctaagaataaggtaaaaaaggcccataaggccaagaaagtcagtggggctaatgttcctaaactttctagtttgtccgaaacagaaaaacttaaaattgctaatcagtataagcagactgcaccagtagttattcctgacagtgcaaaaattaatgccaagactatgaatgctggttatgaacaaattacttataagtggaatgatggtcaatttaagtatgaagtaaggtggcatacaagaactccaggagcacctttagaacaaggtaatacatgggttgttcaaagaacagtacctggaaatggaggaaacaagccacaaacattctttaaagttggtgataatgaatgggtagaagggtataaatgctataaatgctataaatgctagaaaagcaggaaatgctactccagaacaaatgaaaattttagataagggtcattggaaggaatgaattagatgactgatagtaggttttatgaaggttttgagggcgaagcagagcttacctttgttgctgataataataaacttgtaatttggaatggctatttcgagactattttagataacttattagattgtaatgtagaaaaagagggaattgtgaagaaatattttaatcatgaaggatggtatgacgattcaccatggttgataaaagataattctcttactattaatcaattaaaacgttttaatattaacaaaattaatcaagctttaatcaaagatgagctagaagaagtagttcaaacgattatttcatttttagaaactaatcgtttgagtaaaatctatattgaatacgaataatcaaaaaacaaaaaggcacttaatcacaagattggtaatcaagtggttgaaccttgactagtaaggactaaacttactaatcaatttgctaatagctaacaaaagctagctatatttatcgtgcaaaaattcaatatcgaaaaagaagcgatttaagtttatcgtttctttttgtgtacttatttggagccattctccctaccccaagaaagccagtggaggtaaagttaagaagtaccttaaaggtcgtgttttggatggagaaagaattaggagtggcaaaaaatagatcaccccaagagtataaaagattcaaacggaaatataataaaagaatttcctcatgtatcaaaagagcatggttttccagatataattgataattattctagatatgctgatgaattttcattagttggagaagatggggtcaagcgtaggctatttcatggttgttaaataataatgtatttattatttaattattttttattgcacttttaaaatggtgttgattaaaaacaagcattgtattcaaatcgaaactttgaaaagtggatagaaattggatatcatcaatgtttataaggaaagacgacgaacgatacccgataagaaatgctcgcgttggtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgctcgagcaactaaactggcgatgaagcgggcggctgagaagctagctaaacgaaagcccgccaaaaaggctgcgaaaaaggcagctgagaaggctcgtaaaactaaaaaagtcaaacatgcaaaaaatgtccgagcaacaggtcaagcaaagcatgaggcaacccatcgcgctggcacacagttatccaaagcaaaagctaagcttgagcgagagaaggcagccaagcatgcgaaaaatgtccgagcaacaggtcaagcaaagcatgaagcaacccatcgcgctggtacacaattatctaaagcaaaagctaaattaaaaaatagaattggaaaagttcactttacaaaagaggacaaaactgattctttaatcaatcatatttataaaaatacggaaggacattttacaacttggtcgcaggaacacgatgagactttgcttagagttgcgcagcgtaaatctaattttaaacgtatggatatttttggtaatgattggtatgcggaaactactaaagatcataagcaaatttgggttagagttcgcgatggaaaaataactgatggtggtattaatagtcgaccagttcctgttatgaaagatggaatgcataaagtttcttggtatatcaagaatggagtgaagttaccttgataaaaagattaagtgaaaaggaaaactacttctcaatgtctgagtttttagagtcctactattgggcaagtaaagatgatagtctcggaagtttattggggagcgtcacgttatggagcgacgatggtgaattgtttgatcaagcaattgcggaagactggcacgcgttctttagcgacgtgagcaacgaagatcacactatgtttgagagttttcaagcagtcaagcagtttgtgaatgaatatttaccggatgttgcagaaacgacaccattatctcgaaatttgacgtataatatccgaatgatttgcgagatgacagaagcccaacgaaatcaagagcccgtatggaaaaattgggttgcggcagttaattggattacgaatcctaatgttgttccagttaatgaatcgccctttcttgaaaaggggcagtccttgcctaatccggataacaagggctttcggaaaaatcaatttccaatcgctcaggttttgccagcgccacgcccggaaattccaatggaagactcccctgagatgttaactgttgaacaatcatttcaggtacagctagcttttatgcggcattattatcaagttactagtgatagcgagttagggaactatttacagcagtattcgaaggttgacggatccaatataagatacgaaaaatggtgtagaaaattttcggaacgtgctgaaatcgagcgtaaggctagtagcttgactgtactggtgatggcaaaagattactatgaaatctttttttcagacaatgctttgcatgcgcaacctctgcgtaagttaagctatgaaatctggaagacagtttatctgccacacagccaacgtgttcagactgaggtttggcagaattggttaacggcagttcatcaaataatggagtaagtatcaatgtcattaaaagacaatcattttggagggtaagttagtgctagttattgtggttattggattatttttgttggcggttaccctaggtttgggatactggagttatttactgggaaaaaggaatcaatctaatcttgttggtaccattattccagtagcttattttgtcgttcgagcaatcttagcttggatgacacaaactacaacacatggcctagtatcgtcattagtcggtagcttgttattcagtttgatttactatggtttatttgtttgggggaagcaccgggctaataagtaacataaattagtcagattgagatgaccgatattcgacaaggattaaatgccgagtatcggttattttatagaacagtttagacaagttgagttatgagggaggaaacgacatatgctggtatttattgtaattggattgattacggcggtaatcacaattggcttgggttattggagctatattttagggaagcgtaacaagtcgaatatagtcggtagtgttataccagttgggtattttatcgtccgattagtctttgtgttagtactgggtgaaggcgttcgagaactgataaccagtttagttggtaatttggtgattaccgttatctatgtcctgttgtttgtttggggacgacaacgatttaataggcagaaaacaaaatagttcggttgaagatccagaacgttgatggaattacgcgttctggactttttagactgttaccggtattaataaaggcatcatttcgtttttgacgaatctagttgggtataatgatatatgcttacggggaaagttactgctaccggtaagaaacatttgcggttggtaggagcggcttggacagccccgaactttgtcccgtcttgaaggttgctaagttaacaaaggccgcgaagattctggcaactgctaagaaggccgagcaacgaaaaaagctaagtatcaacaggcgaagcccaaaaagacttcccatggtacgaagcgtaaaacgaccaagaagcagccaggcaagcgtaagggtgctaaagctaagactacaaaacgaaaggctaagaatttggttgtttaggagtaatatgattttaaatggttaagtgttcattttgggcgagtttagttagcacgagccatttatttggcattagcttttgccgttggatagttggaattgtcaaggagggggggctattgtgacaaaaaaagagcaactgtattatttgttaaatggtttgagtcatggagaaatagagattaacaattttacaattcagtttacgaaaatttttgacttggaaattgattatgatgaattatcggaaaaagaatacacggttttcgacaatttgtctgatatggcgggtaggttttctgatagtgcagaagatctgaaattgcctaatgtgtactataacgaaaagcagattagagatgaagtatcttatgccttaaaagaattatcgtgaaattttcagaattttcataccaattgtaacacctgcaagatgttctaaatagtggattggttaatatttgtagaatcattcacggattttcttatggaatagtctctccgattttactatgattcatttgtttggaggagcgcctagctaatagataaaatgaattggttcagcagaaatagctggtatttattgcgattaggtgattacagcagtaatcatagtggacttggactgtttgagttatgcggtaggaaaacgcaacaaattgaatttacttggtagtgtcataccagttggttattttatcgtccggttagcctttgcgctgttactgggtgaaggcgttcgagaaatgataaccagtttagtcggtaatttggtatttacctttatctatgtcttgttgtttgtttctggacggcagcggttcaataaggacaaactaataaaataggttggttgaacgttagagtgttgatgatggtagcttgtctcaaacattttagattgttgcagctatttttatttcgcatctgataagatttagttggttataatgatatttataccatgatcacggggaaagatgccgctaccggtaagaagcgctcgcggttagtaggagcggcttggacagccttgaactttgtgcctgtctcgaaagtcgctaagttagcaaaggccgcgaaggttctggcaactgctaagaaggccgagaaagttgcgaagaatggtggccggatcaaacgggccgcccgagcaactaaactggcgacaaagcgagcggccgagaaactagctaaacgaaagcccgccagaaagactgcgaaaaaggcagctgaagaggctcgtaaagcccaaaaggccaagcacgcaaaagatatccgagcaacaggtcaagcaaagcatgaggcaacccatcgtgctggcacacagttatccaaagcaaaggctaagcttgagcgagagaaggcagccaagcacgcaaagcctcaaaagacttcccaagttacgaagcataaaacgaccaagaagcagcagaagcgatacaacaagaaaaaagctgcaggcaaggctaggaaggcttcgtacgcacggaaaaagggtggtactaaaaagaagtcgggcaagcggaagagtgctaaagctaagactgcaaaacgaaaggctaagaataaggtaaaaaaggaccataaggctaagaaagccagtggacctaaagtgaaaattgaaatttctaaagaaagattagagcatgctaatttaggtaattttactatagatccaaaaacaggaaaaatttcaatgatgaaaggtggagggcatgagcaagataatattgactttttaagaaaaaatggtttggaagtgaatatcgaaaaaacgtatccaaatggcgtaagagttgggaatgtaccgaaacataaaagtcaaactaaacgtgctggtacaggtcaatcatggtttccggaaaactggacagcaaaagatattgagagtgctggacagcaagtagcaagtcttccagaatttgcaaaagcaaaagatggagaaactatatttggtgaggttaatggagtgagagtaggagtaataaaaacaaatggaaagattggtacaatttttccagatggtaccagacagccctaagtttatctatttagtaaaatattataaggaggaaaattcatgaatatatctgatcaaattaaagaaaatttagaggatagaagaaagttaaatccaaatgatgattttggtattgagagaaattgggaaaagttaacaaatatattatctgaaaatgaagacgaaacgattaattatttgaagaattgttctaaagaagaagtttcttggataagcgaagtttttgatgatgtttccgaaaaattgcaaagtaagaaatttatagcttgtttaagagaacttgaccaaaagtttcctgacctgaaattaacttttttcattgataatgcagaaaattatattaaagaagattaaaataaaatttaaaaataaatataagagaaatctaaaccttaaaggtaaccaacgatgattcattgttggttatctttttaagaaaattccaaatgttgaacgagcaaaagttgcgccttggtttggtatgccaggtgggggcattcaaaacaaacttcctatgtctattgaagaacttgttaagagaggatatattgaattaataacaaaataggagtggtgtaatgtttaaactatcaacggaagatttgaaaatttatatattagaaagagtttccaggctgggaaatattaatattaaagaatacaatttcttggaaaacaagcatggaagtgaagatggtttttatatttattcggatggtcagcgataccattttgtgtatagtgagcgaggaacagaaaataagcataatgtgaccgataatctttttgaaataacatattgggttattagttctattacagatacgttagcaataagatacatgagaacgcatattttaccaaatcaaagtcaaagaaaaattatttttgataaaaaattaagtctgttaagtatagtaggtgaaaactataagaaagctggagaaatagaaattagtgaaatattgaaaacatcccctttataggtattctgaactgccagatcaagtacaacactttcagactaagcaagtaatctagttaatcaaagtctggtagcaatcttattgctaattagtaactaagaatttgatgtagctactggctcgaggtgtttaggatagcttgagaactaataatggtcagaaaacaacgaataatctttgagtatgagctccccaattaattgattctagttctcgttggtaccatattcttgtgttgagtaagagcgcacaaagtggatgattgctgaatattggttacttcttaagtaaagtcgcgaaaaataaaataatggtagaagatttagtatgaatcctccagaagaaattaaaggaagctcaaggtatattcaatatcaccctggtggtcaccatggcgattcaccttattataaagtttcttctccagaacatggaattattaggatttatacgaatgggaaggttgtgaaatgatgactgaagacgtagaaaagttgacaatgttatatgacagggttatcgagaatcttcaatagttttcaatgtctccagagaatcagataaaacaattaaaaggtttttcggtcgctgatgaactagcttcggatttttctgatattacattaaattatgcaaagaaattatttgaaaatgcttggataactacaaaacagtattagcagttcctgagcattgatgaaaaattagagggtatgagtaagaataaggcgctttggtgtgaagaagcacttaaagatgctagtgaatggaacaaatgtaggaaagctggaacaaaactgctagcatctttggagggcgaacgctcgacctattcttaaacaatgatcgatttaatcaagacttggtagaatatctatgcctgcttgataaccagatatttgctgtggttggtgattcaaagcatcttgaatagatttattaataaggaataatctttttattgaaattaaaatcaattcagttagtaggaacattgtaaatgtaacagttacttctatacaatgatattcaaaacggtgattttatttttatatggaagcatatccaaagctaaccctattattaacatatatgagttcgaatatgaggctgtcattactagcaatagtagttttgaattttatatggggagaagaaaatattctttatacttgataatgaagaataaaacaatcaagaatcagacagtaggttcggttattttatagaaaatcttagacaagttgagttatgagagaggaaataatacatgctggtatttattgtaattggattgattacggcggtaatcacaattggcttgggttattggagctatattttagggaagcgtaacaagtcgaatatagtcggtagtgttataccagttgggtattttatcgtccgattagtctttgtgttagtactgggtgaaggcgttcgagaactgataaccagtttagttggtaatttggtgattaccgttatctatgtcctgttgtttgtttggggacgacaacgatttaataggcagaaaacaaaataagttggttaaaggttcagaacgctgatgaagcacgcgttttgggcttcttaggtacttacaagtgatggataccaaaatctatctaattaatgcagcaatcaaggcttttcaaaaaaacatctaagagcagtgctgaaattgccacgaatgccggaaaacagagcgaggcagcgtaatggcagttctaaacttaaggctatgttgttgaggatagcagttatcaaatgaatacccaactgtggcgttgccaacgatcaacgttgctaaggtgttggcaaaaaatgaacgagaattaattattttgatgcatattaaaaatcagtccgtcgtattctgccgtgataaagacagagaatgcgatggactgattttttgaaaccactaatttaacaagctaggatcaatctggcggtctttaaagtagtacagacggtcgtgatcattaatgtgtcgcaagatatgggcgggattccccacggcgacgacgttatcaggtaagtctttggtcacgatgctaccagcgccaacgacgacattgtcgccaatcgtaataccgggtagtacgatggcacctgcgccgaaccaacagttacggccgatatgaactggcatattgtactgataagcttgttcgcgcaatgatggcaaaatcggatggcccgcggttgcaattgtcacgttggggccgaacatcgtatagtcgccaacgtaaatatgggtatcatctaccagtgttaggttaaaattggcgtaaacccccttgccaaagtggacatggtgcccaccaaagttactgtgaaacggtggttcgatgtaacacttcgggccgatttctgcgaacatcttgctaagtagaatttggcgcttggttagttcgctgggccgagtttggttgaaatcatagagctgatcgagatagccaaattggcgtttttcaagttcagggtcgttaggtaagtagagttcgccagtatgaagacgatcgttattattggtcattaattaaacttcctttcgtggatgatggctgccggtaatcaaggctaagccacctaaaatgagcataatccaaatgagaacgttggcggtgagcgtctgcggcccaagttggccgagactgttccagaccagtggcgcaaagaaagcgctgataatggtggcaatcgtcaggtagctactcaggacgttgacttgaatggtatccaggccagtattgctagtgaagaccaaatatggcccggtgtacgagtaaataaagttgaaaaatacggcagcgccaatagccacagttgcattggatgccaaccataatactaagactgaaatagctgctccggcatagcctaaggttaaggtgaaccggtgtaaatagcggtatagatagccaaaggtgagaccagccagcaagccaccgatgttcatggctgctaaggttaagttgatagtggcagcgttaccaaaatgacgggcgctaaagtaactcggcagctttaattgaacgccccagatgagtagataggtgataaaggtaagtcctagtaacgtccactggtgccgtggtagttgtgtcttttcagtgcgtgcgtgattagtcgttgttgatggaacagtgggttccggtacgaaccacgccacgcccccagcaacaatcaccagtagcccgtatagccaaaagacggcatgccaactgagactgatcagcaggcctgctaatcctagcaatatcgcgttacctagggctgagaggcccgtctggtaacctaacagtcgggcccgtaaatcacctgtaaagctgtgggtcaacaaactgatggcatgtggtgaaaagaggccgacgcctaatcctaatccgagccgactgaccatgattacggtaaagttagtcgtgatagtgggaatcagtcccatgatggcgctgatcaagagtccactaatcacgattggccgtaatccccaccggcttgttaatcgggggttgagtaacaaagtaatcaatgcgctacagttggcgatggtgacgagccattcaatcagcgtagtcgggacggtgggaaaggtccgtttgagctggggaatgattcctgtaataacggtagtgatgcctgttacagtggagaggctaagaatactgatggtggtggtcaaccgtggctgcatggcttacgcctccaaccagtttttgattcactgtaagacgccttgttcttggtttgtacctgtcgtggcgttggctacggctgtcacggctggttgagcattcgccatggcaacgccgcagccgacctcccggagcatttctaggtcattgcccccatcgccaaatgcagccatgtctgcgaggtcgattccgagaacctgtccgagttgcgctaagccagccgccttattcatgccgggttggataatgtcgatgtcgccatgaccactgctggttggttcggcgatacccgtcagtaactcgcgtagttgcgtcacaatcgctgtggtgcgttctggtggacatgtgatggcgaacttcataatgtcatcatcaagctggtcgtaactttcaacgacggctaagtgataataatgtcgcatttgcgccacgtgctcaggattagtggtcgttagggtgtaggcacttttggcaccgcaaaccagtagctttaaatccgggatggtttgaatcttattcagaatcgtctggattgcgtctggctgaaaggcgttaagtgcgtaaacgtggtcggcatcgcggatataagccccattttcagcaaggtagatcatctcaggatagtccttgaagaaggacttgagttggaaatattgattgccgcttgcaatcacgaaccgtacgccccgtagttgtaattgttgataaagcagtgcaaattgagcttcgtcgtaagtcatgtcgtcacgcaaaaagctgccatccatatcagttgccattaatttaatcatggttaaaatctcccgtcgtttaattgatagccgtagcttaccacgaaattcagatcacgaagggacatttttagaggcaactagtatcaattcggtgataccgggcataggcttgacgatagtcagtaggcgtcatacccttccaagatttaaaattccgattgaacgtcttactattcggaaagccgcattgcatggcaatatattcaatcttatggtcggtctctaacaggaggcgacgggcgttcatcaatcggatcagtcgtaagtatcggttaacggatagttggacgtttgcattgaattgctgattcaaagtggtcaacgaaacgtgaaattgctcggcaagggtattaccatcgatgggctcagcgtaatgttgattgatggcagtcatgaccgtatccgttaacgtcaagttagggctgaccgttgttgcagtcagaggaacggtaaacgtttgccccagagtgacaagtaactggtaaaagtggctgaggatttgtaatctcagtagatcggtcgtgggggtcgtcaacaggtcgtgaatcgtgactaattgttggcggacatcggcgtaggcttgtgggtgagttttcgatgaggccgcgccgttcaatgtcaattgccagttcgcacttgccggaatttgagtttgtaagaaatcgtcgtcaatgatgatgccgaactctacccagtcaacttcggtgggcccactagcgctgtgaaccacgcgtcgattagtagtccaaaggtcaccaggccgatattcattcgtctgtccatcggtgacgaattttaaggtcgtaccgctgacgagataatttaactcaatcccttggtgccagtgtggggcaacgttgatatcagtcaatggatcatgttcgtaatatttaaaggggaggcggggaattgtctggaccgtctcgtgtaagattttcatcactaaacctcgcttcaagattttgtaaaatcgcaccgcttcctttcaaaaatcaaccttgatggctgacgcgctatgctatattagaattatagttcgcgatgagcggtggcatgacttaattgtaaccgtattcgcagttgaaaggaacgaaaatccatgacaattaaattaattgcgattgatattgatgacacgcttctggattcaaaggggcaattattaccaagtacgattgcggcagttaaggaagcccgcgaccaagggattaaggtggttttgtgtaccggccggccacttgctggggcgcaacattatttagatgcgttaggccttgctggtgatgaccagtacgtgattacgtataacggtgctgtaatcgagagcattgctggccggattgtcgccaaacatttagtggataatgcgcactatcggcaattaaccgcgtttggaaaacaacatcacgtgccctttaacgtgctcgatgcggacagtacgatctatacagctgaccgcgatgttaactgggtcacagttgtacaggcgtgggaaaacaaagctgggctgttgattcgagaccctgacgatttaccagctgattttcaaattgccaagggggtctttgtaggtgaaggcccgcaactcgatgccgtagaagcgcaagttaagacgacttttggtcgggacctgtacgtggtacgtgcggcaactaacttcttggaactgatgcatactggtgtcaacaaggggcaggcagttcaggatttagcggcagctctggaaatacaaccggacgaagtgatggcactgggagacgaacagaatgatctgccaatgtttgctttcgccggaacagctgtcgcgatgggcaatggcagtgatattgctaaggcacacgctgatcacgtgacggctactaatgatgcgaacggggtcgcagctgcgattcggcagtgggcattatcggattaactcggatgattatttttagcgaaacagttgacaagactacgcaatgagtttatgattgcaaatattaaaaataaatgagactaaacgtgatgatcaggagagtaaagtcagggtaatcttaagcgagccgctggatggtgtgaagcggtggtgaacctggctggaaagtagcctgagaactgctaatgcgacgagctggagtgttagctgggtgcccccattaacgggccaacgtatcgtcagttaacattactgtttggggaaaaccgtcatcggtgttggtaattggccgtacgcgcaaaggtgacgagctgcggttcgtgacgaattaaggtggtaccacgcgttagcgtccttacaaaatcaattgatgattttgtaaggacgcttttttagtctcatggcagttgagaggatggggacaatgcgcttaacaagtagtgatggtggtttgtatcgagtgctcttactagtgattgttcaaactggttgatgagaacgacgcttaacggaggagagacgactatgcaaataacgcgaaaattaacaatcaaacattacatcattattggatcaatgctctttgggatgttttttggggctggcaacttgattttcccaattcacttagggcagctagcgggggccaattggttgacagctggttggggattcttgctgacagggacactattgccactgttaggaattatcgccatcagtgtgacgcacagtagtgggatttatgagctagcgcggccaattggtaaacgctacgcgacgatttttatggtactgacttgtgcgactttgggacccttgttcgcgacgccgcggacagccactacgccgtttcaaattggcatcgctagccatgtgagttcggcacaggcacagtggtatttattagcttactcattgattttcttcagtatcacttactgggcagctcgtaggcccacccggatcgtcgatacgatcggtaaattgttaaacccagcttttctgattttgctcgccttaatttttgggattgccttcagccggccgttagggaccacgaatgcgacaccgaccgcggcctaccaacacggcgcgttcttgaacggctttttgcaagggtataatacgatggatgcgttagctgccttgttgttcggaattgcagttgtcaccacgattcggggccttggtcaacgggatgccggagcgattgctaagacggccgccaagtctagtttgttgagtattagtttagaagcagtcatttatcttggcctgatctggattggcgcgacgtcgttatcgcaatttaagttgtctgcggatggtggcattgcctttggtcagattgccaatgcttttatgggcacgccgggtgcgattgttttagcgattatggcgaccttgacgtgtctgacaacggcagtgggtttggcgacgtcgtttgcggaagccttgcacgctaaatttcctaaaatcagttatcgcgcttggaaccgcttggcctgtggggcctcatttctcatcgctaatattgggttggatcaaattattgcatggtcgacgccgatgctgatgttcctgtatccgttggcgattacactgattatcttagcgattgcctcaccgctatttcatcgtgatccgctcgtttatcgatggacgacggcgttaactttgattccagcgttcattgatggtctaggtgctgcaccagccctgattactcggttaggatgggttcaaacgattcttgcatgggatcaacgctacttaccattagctaaactaggatttgattgggcacttcccgccattattggtctactgatcggcttgggctggcactatgcgcgccgcttccagaacgcccatgcttacaagatgagccaggactaaaggtgtatgatagatggtaagacttttgatggatgggtgagcacatggattttttgggaatactttgtttgttgattttggcgacaaccctcgctgggcactttgctcaccgtgcggggattcctgccgtgattggtgagattctggtcggggtgatattagggccggcactacttaactgggtccatttaacgactttagttcaaacgttctcagatattggggtcgtggtactgatgttcatcggtggactggaaagcaacttagcacttttacgtaagtatttacgccctgccattatcgtggctattattggagtgatctttccagtcgttattatggggcttgcgagtcgcttctttcagtttagctggtttgaatcactgtttatcggtgtcatcttttcagccacgtcggtttcgatttccgtggaggtactaaaggaatttaaagtgttggatactaaggaaggagccacgattctaggggcagcggtcgctgacgacattatcggggtgattctgttgagtatcatgattgcaatgatgggtggtcagagtggcgttgcccagactaatctcggtatcgtgctcttggaacaggttggcttcttcataggggtcttcatcgtgattaagtgggttgccccgtatctgatgcgcttgagtgatcatctgttgatggctgccagtccaactattatggcgattattatttatttagcgttggcatggttggcagaactagtgggcttgagtggtgctataggtgctttcttcgccggagtcgcaattgcacaaactgattaccaacacgtggtggacgttagtattgaaccagtgggctacacgacgtttattccattattcttcgtcagtgtgggtttaaatatgacgttcaaaggggtctggcaatcgctaccgttcatcgtggtcatgacggtgctcggtgtgttaactaagttgtggggttgtggactgggcgcgaagttaaatgggttcagtcgccatagtaattacttagtcggtgccggtatgatctcgcgtggtgaaatggcattgataacggcacaaattgggttttcagcgcacttactatcaaacgattactattcggatattattttggtcatcattgtggtgacgatgattgccccgttcgtcttaaagaatgccattcatcgtgccggtcaggtgaccgcaacacatagcatcatagaagaacattaaccacatagattgggcggaagttaagaaccgcttggacgccgtagtttgagactacggcgttttttgagtctggtagatttgaacgaggcgttagggtgttgcattagcatgttgacttattgtcgtggtggttgtcgactaaacggctattttcgtggtatcggtaaattattgtacgataatagctaaaaatatgacgtttgtaaaaatatcgttcgataggtcgggtaggtgttatattaagagcatagaaagcaattaatatttaattgataagcaacaaaagtaaactgattttatcgttaaatatttttaaagaatccgaatttttaaatcaaattgatgaaatataaatataggaaaaggtgattaaaatgaaaaatattaataattttcaggcattgcaaaaaaatgagctttctaaagttaaaggtggtagtaataataagttttggacttgggctggttacacatatgagaattggcgtatttcatcaaggcgagcgtttaatctacgtcagcgcaaaaacactatgactcatcattagaaagaagtggtaaaaatgagaaaaagcatcagtaattttaaagcattaaatgaaaaagaacttggcgctgttaacggtgggatttggcaatggattgtgggcggtttaggctttcttgctggtgatgcatggtcccattcagatcaaatctcaagtggaattaaaaaacgcaagaaaaaaggttatggctactagcctttttatggttaaatacagttgttaaggtgggtgattaacctgaagaaaaatacattattcaaaggctgtgcgcttttaatttctcttttgtttgttcttttaatgtttcgggtagataaagacatgatatggctagcatatgcctttgcattgctagctatacctaggcccaggcccaaatatcctaaaagctatgacaaatggtactatatagcatttttatttttctgtcttgcatatttattagaagaaaacattttgggaaatttgggaattatagtagctgtaatttcttttagtccaactactcatccattcgctaaaaataacatcgataaaaaataacatgaacctaagtgcagcactaatgagagtttatcttcaattctttagtactgcacttcatttgacaattctggggcattattcctcgttggtgtaggtttaaatataatgttcaatgagggctggcaatcgttgccatgaggtgtgttaactaagttgtggggttgtagactggattcgaagctaaacgagttcaatcgtcatagtaattatttggtcggtgccggtatgatctcgtgtgaggacgatgattgcgctgagagcgctatttgtcgcgctaatcggtattacgagagtgcaatacttcattatttactggttgttgatattactatgaaaaacggctccaccgtggtaactgccacagtggagccgtttaagcaaaaattgaaaaattatattatctcatttgtcattttgacagaaaggcatacaaattcactcgtatttataatgtgctatcgcccagcagccccatcactaatcacatagattgcgaaaactacaataagcactaccagcaagcttctcactgggtatttcttaatgatgtttattgttttattgagcgacaaattgtcaaatcaagtgtaactttttaccgaagaaaacttcagacggtgtcttccagactaagaccttacggggtcgattatttaaatccctgacaaacttcgcgatatcttgatcggtcagttcatcaaggtcagttcctttgggaaaatactctcggatgagaccattggtattttcgttggtcccacgttgttgtggtgcgtgcgggtctggaaaatagactgagatatcaagctctttaccgacttcacgataacccgcaaactctgtacctcggtctggtgtaagcgtacgaacgcgtttaggtgtgactgtatgcaggaggtcgatcatcgcttgggtcacattcttggcattcactttgggtacacgctcagacagaaggtatcgtgacttacggtcgaccagtgacactaaacccgaacgcccgatcttgccgcgaacggtatcgccttcccaatggccaaaacgagtccgattctcacatgagactggtcgttcatggactgatgggacattattaaaacggccacgtcgttcgttgacagttcctttaaccttacgagttttcccacgatgtcgtaactttcgagcgaatcctcgagccccatgacttttacgtttaacgcctaaattatttcgttcaattccgcgataaatcgtgttgtagctgatatgccaattactgttctctaaagataaacgaccggcgatttgctcgggtgaccattgccgttgaagaatgcagtgaaggacaaagtcgcgtagctttaaattctccagtaccctgaggcgacgactctttaatcggcgctgttgatagttctgctgggcttttacggcagaataggcaccccgaccgccgttgcgtttaatttctcgtgacacagtggctttggaacaaccgatttgatcggcaataacctggtaagtatggtgtaaagttacacctaacagtatgcattcgcggtcttttaaggtaagatgtgtatatggactcatagcctaagaactcctttagatgattgttatggtgacttcattctacaggactcaggctaggagtctatttttattttcttacttgttgcacttcaattgtaaattcgtcgcattaacgtgtgccttaccttttatatttaaattaatgtgccaataattaaaacggcgtctgagatccaatggacatagatgccgctccgtaaagtatttgcagatcgccatgaagcagttattgggtaacgcgtaataccgacgattaagggataaagccagttgaaatgataatgtggaaggtgcaaacacgcaaatacgatgcaccccaatacattgataatcggccacgcatatttttttagttgtgtttgcgataataagcgaatcaacggaattgaaatagaggccattccgacttcctcaccaactagtgatactagtagcgtgaaggctatccatactctttcaattaaagggtaatctcgcccagttgaattagttgtcaatgttgtattatgaaatgacaataaagcatgcgaattaataatagctataaccacaatcgcagtgacttccagaacaaacagtaaaagcacatacttcatcactatacgccactttggtgagggcaatggttgaaagaatagttttaagttagaaaaaccatatagcattactaaactaattattccagctgtaagcattgctaaccaatcaaaataaatattaaggaaaatcgcacccatataaccagccacaaagagcactaatactagcgggtaatatcttcttttaaaatcaatttctatcatctattataatcctccgagacatcagttatagtgcgtgtgaccgattcaaacacgtattcaacgacattcttacgactctgccagcttcgccagcataaaatttgaaactagaccagaaatttttccaagagccttccaacaacgccattcaatttattattggaaatagatgcaaatgcgtctactgtatccaaattcttaagtgttttatccatagccataccgcgccatttactgcggtaattaaaatggttctatgagctatgtttttagtacatttattaagatacactacaattctaaaaaaatcatttttaaatttattatcgtactattcactcgacttaacgtaacttttagattgaatatctggcgattccgttccaaagtttttcgtggacgattatttaaggtgagaagatgatatggactcagactgtggttcttcttattaattgtttgttgtacttcaattgtaaatttgtcatttattaccccttttttgaaaaccaaaaaattatagtagcgataattcctttcagactaactgttcatgtattcactaaaaataacattgataaaaacaacattaatctaggtacagaattagttggagtttgtcttgaattttttagtgctatttttgcttgacaattctaggccattatttttcgtataaaactaagttaatgatgaaattgagaatttatgctgttaagaatggagtgatctaaaatgaaatccaacaatatgaaactgaaccgcgatttttataaaacatattctttttggctaggggtgttagctgtgattggtcttgtaggagatgttttattaaagtacaataccgcggttagtccgtggataatgatattaattgcaatctatttatttttgagagcctttacaagtaagagaaaataaatattattaacggtatttttggcattatttaaatttacttagaggaaatgatttgaacttgttcacgataaataacattaatctaagtgcagtactaatgggagtttatcttgaatgctttagcgctgcgcttaagttaatgttattttatcctctaagtatgttcaaagtaatcaagagctattcaaaatagtggctttgacattcatcaaatattgattgatatcatagtggaaattttatgttgattcacgtttaaattcaaaaaatgcacgttaatagaaataatcccagcgtacctcaaaaacaccttatcctaaaagcgaggtgattattatgaaaattcaaattaaaagtatgaagcaacttagtaataaggaaatgcaaaaaatagtaggtggaaagagtagtgcgtattctttgcagatgggggcaactgcaattaaacaggtaaagaaactgtttaaaaaatggggatggtaattgatttattgaataactgttttttcaagttatatttcgtatagatggcgtaaggtggggcatttttaaagagtcacaacacttgaaaagaagactataaaatgataattttgctgataaagtaaactaacaatcattattttagaatagttagataatgatcgaataaaaaatactttagaggtagtagcttggttgaaatcagtatcttcgatagcgttattcaatcgtttttcatttatcttggcattatcttggtatataacttcatcttcagtaatacgaacattaaaagaatcatttattcgttgattttattactagtgctgtccttagtaggagctatcttggatgacactacatcgctaattttggttttgggggcaattattaaggaaaagtgccaaccaaaaataaattattatcatctaaatgtattcttaatgttgatttctagtcagatagtaattttagctttggcttcttatttaagtagaggatttctgtatatctacttagatgccgataaaatttctggcttgtcggagtatggtgatttattcattggtattgaaattattgtgatgtatattatcggatttttggtgttcaatcttgtgtacaaaatggtgagacgatacacaggctcgtttgatataagtgatgacgaaagaataaataggcatctattcattatattgttagctttctttggatcaatagaaatgttgagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatatcgcgattggcattcgtccagatggtacgaaagaagtgctgaactaccaagtggcgccaacggaatcgactggaatctggactgaactgctgggaaccttgatcaagcagggcgttgaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaatctgattgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctaccgaaatgttgttatttattagcaactttcaaggtgtaacagctacaattcaactaactttactgttgacatttgttttgatgcttgggcttattagttggcaaacattagaaacgattagagtatatacttggcaaaaaaagatagcagctgaaaaattgcagaataagcaattaaatgattatcttaagagtgttgagcatcaatatctagaattaagaaaatttaaacatgattataagaacctaattgctagtttaaatactcaagataatataagtgaaattaaggattatttgaccgactatacccagagcggagaattcagagcaagcctaaatgacggtagcattgcaagtgttcagcatctgaagaatgagatattgcgcgggttagttgtacagaagtttttttatgcgaaacagtgcggggttaagttgacgattgaaatagctaacactgactttattctcagtcatggtgttacagtggctgtacgtattattggtaatttattggataatgccattgagcaagcccaaaaaatgactgataaaatagtgacagtagcttttaatgaaattgataacaccgctgaaattgccattagtaatcctatcgattcagattttaatcagcatcagatttttgaaactggttattcaactaagggtagtaatcgtggcttaggtctgactaatgtgcgggatcttgttgaacagcagaagggtttctatatggatattgaaaccaagaaaaattatgtcacaatgacgttaattgttacggaggataaataagtgtttccaatttatttattagaagataacgaggcccaaagagtagagtatataagtattataaagaatataatcatgattaaagaatatgatatgcagttggtggtggcgacaggagatttacaagagttaatgaataatgttatgaattctaaagaagggctgtttttcttggatatggaaattggggaacaaactcaggccgggttgaatttagcagatgaaattcggcagcagttaccttttgcacaaattgtatttattacaactcatgaagagttatcttttttgacactggagcggcggattgcaccgttggattatattttgaaagaacaaggccttgatgatattaagcaaaaaatagttaaggatattgatgcaactcaaactattctcaagacagaaactgtgcagcataaggatattttaggttataaaatcggaacgcgtttcttttcagttcctattaatgatgttattatgctgagcactaataaagaacgaccgggtagtattaggctgactgccaaaaataaagtggcagattttccaggtaatttaaatagttttgaaaataaatactcacaattttttaggtgtgataaaagttcattggtaaatatagattatgttgatagttatgattatcaaaaaaaagagcttaccatgatagataacattaagtgcagtgtttcgtatagaaagtctcgggagcttaacaaaatattgaaaaagaaataggaaacttatcttttatagccagggcaatgaatcgtagtatcttgttttgagatagactgcttttcatggtaagagcaagcaaacaattatatttttgacaattttggaggaagaatgattgtttccaatttatttatacgaggataatgctgagcaaagagataattattgtaagaccgtcaataatacaattatgattaatgagtttgcaatggagcttagggttgcaacggatgatcaaaaaataattctagcagatttgaatcaacaacaagatggccttttctttttggatatggaaattggtgaggacaaacagactggacttgaattagccagtcgaattcgggcaacgataccattggctaaaatagttttcattacaacacacgatgagctatcgtttgtaactctggaacggcggattgcaccgttggattatattttgaaagaccagtctgctgacctaattacgcaaaggattattaaggacatcaatgtagtacagaacgaattaaaaaagactaatagtcagcgcaaagatgtttttaactataagttaggaacgcgatacttttcactcgcattagatgatgtgattttgttgagtacatctaaactgcgtccgggcagcgtacaactccatgctattaataaggttgctgagttcccaggaaatttaaatgcgctcgaagaaaagtatccgcaatttttccgatgcgataagagctcgctggtaaatttaaatcatttgcgaagttttgactataaagaaaaagagttgttgctcgacggtgaaattaggtgtaaggcttcgtttagaaagtcgcgggaattgaataagttgttgagagacaactagttttttaatattatttagagcttctgtcagtgttatttgacagggctcttttgttatgaatatgaaatctgattatataatataggcgctgaagatagttggagtagggctctaattgtgatcttatgagtattaaaatgactaaaaagtaagcacagtactcgatcgtaaagtatattagcatagcgttaagacgtgaaatttagttagcgatatgactagctcttagcgtaacccaaaacttcagagataattgaaattgtagtgctgcaaacaataatttataggaattcagaatggatgattactcgtctattttatcttcaatatttaggatactcaataacttccaatgcttagaggataggataaacgtagcaatgccaatgaataaaatatttagaaagagcccctttagaagagcttccattggcccgttaatgggtgattgagttgggtcaataccttgagaatagaaactagaaaaatctatcaaccaatggacactaatggcagccagtaagcttccggtttttaaatagattgctgcaagtaaaatacctaacccaataacatagagaacctgacacaatactgaccatacgggctgtgataaaaggttgaccaaatgcatagccgcaaaaataagcgaagcagtcatcatcgaagcgatggtggcctgcaatgtggcaaattttttaaggtttagtgctaaaagcgttctgaatatcatgccacgaaaagcgtattcttcagttatcgctacaatcaacgaaagtaataatgagattaaaaattgatacatgtggtttcgaaagaaaataagtagaaatattattgctaggctcaaaggcagactattcttctttaatattgacatgatattaacgggtagccagtggataggttgcttaacatatcgcctattcagaatgattatcgcgattaatataatagattcagttaatatgaattgaaagggtccgtcttttattcccataatatcagtcaaaggattcattaaaaagagcactattaggtagtaaatagctgtgattattacttttattaatggcatagttaaaattccccccatataaactaaaaaggctgagcactgcaggcccagtcataaatcgagtgctttcttatagtgcttaaacttgatggcttgaactatccgtggatgaatcctcggacagcgctaatgacccaatcggcaggcccaacagcacttttataattattccgaacgccacgcgcgctataggcatggaaaacgccacctgaaatagcatttaattcacggtcacgcaaaactagaaattttttcataattgttgatctcccccaagaaaattaacgaatacttttcaaaataccacgaatgcctgcaactgaaccaattgcatcaacaacatgtcgaacacttttaccaaagttataaccgccccgattaaaaccaccagatattttggcaagctttttttgcggcaacctggaatattgtaacttctcaaactgtagcataaataatcccccttgtatgatgttatttggaacaaatttagtttaatttatttttttaccagattgttgaaaaaattataaaagtaaaaaaacgttctcttaacgtcaaataccaatgttggatgtaagctgattcctgagacaacttttaagagagcgtataatgaataaatcgtctctcaaaaggaaggaatttttacatgccaactcgttacgacaaagaattcaaacaaaacatcatcaacctatataaacaaggcgaatcagccgcccaactggccagagaatatggcattggctattcaaccgttcataagtggatccagggccaagccaaaactcaatccggtaaatcgccagacgaaattaaagcgatggaaaagcggctggcttccctgtctgaggagaacgaaatcctaaaaaaagccctgggcttccttgcgcagaagtaaccaatatttttgattacattcaccaagaaagccataaccaccaggtaactaagatgtgccgaatcctcggtgtttccagagctcagtattatcgttatcgatccccaaagccttcaaaacgccgggccgaagatgaggacttaaaacaacggattctgcggatctttgcggaattcaagcagcgatacggcgttatgaagatccaccatgaattgaatctggaacttcaaccactgcagcgtcggtgcagcccaagacggatttcccggctcatgaaggaactggatatccactccgttaccgtcaataaatggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgttacttatcaaccatcatggatctgcactcaagacgaattatcggctattcattctcaaaaaagatggctactgatttagtcttaaagaccctggaaagcgcggttaaaaatcgaaccattactggggacctgattatccatacggatttaggatcacagtataccagcgatgattacaatcaacgtttaactgaactacatatccgccactcatacagccgtaaggggtgtccatacgataatgcaccaatggaatcttttcatgcttccctcaaaaaggaatgtgtttatccagtgccggtctttgagaattatgaaactgccgctgctgtcctttttgaatatgtgcatgctttctacaataggaagagaattcatagttcactgggctaccagacccccttacaagttgaaatcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccagtctcgtactcgcggcaacctacatattatctggccgggatattcgagtcaacagtgtcgtgcacgtcacagctaatctgggcctcatgctaatggcatgaggccagatggatttggcaagtaacttgagtgggttgatctaaaagcccgttagtgaacattctagttacggttgtttggatggagtggatgaaatgttacagaagaatttacggtttattggtaatttactaattgtgagtgtgttgagtgtcattattgtcaatatcagttccttacccgtgtatatttacttgattacggccaattggtttacactgttagttagcttcagtttatatgccgtgattatcgttttcttgtacaacatctataagacgaccgcggaattgcggcaatttgattttcgaccgtggcgaacgcggctaaataaacgggccttgctactcatggtgatcggcgcagtcattatcgtggcgtttgcttttggccatgctaagctgacggcggtatggcacatcactgaatcgggtaatgaacgtgcattagatttgctgttgcggaaaaatccgttagcgatgacactcgatgccgtcatttttggaccaatcgctgaggagctgagtttcaggggctttttctttagttacgtcttgtcagaccaatatcttggccgggagtaccaagcggctaccattgttatcaatgggcttcttttcggttatctgcatagcggaaatagcttggtgccattagcatattacacgctgttcggcatggtgctggggaccatctacctattatctaagcatgatattcgtgtgaatagcgtgacacatatgttagcaaatctggggatactctggttggttcctagctaaaatagttactttggcttatgctaaagtgaacaaggtaacaggtagtaagaatattgtgaatacggtgataaaaatacaaagttggttctgaaaactgtaattgatggatatgtgatattagaaggagtttggtaagtatggatgaaattatatcttttgaattctctaatggttcgaaaattttagatagtaatatctatgaatataaagtaggtaaagaaagcgttaccaaaatagacttgccggatagcaatggatttgtggctgttcataaagataataataaaacagagtatattaaggctccatatatgaaattttgcacagatagccatgtttaaaaatggcccagcattagtttcgtgataacgaaaaacgactggaagtagctagcgtaataccgctgggctacttccagtcgttttttaatttcagttatactcgtacctgatgttcaatcgtaaataatgtcgggtccaattgggcaattagtggggagacatcaccgatgctgagcaatgtcaagtggtgcatcgctcgtgacgcaatcgtatataagatgccaactgaatccgcatcgggataattggtagcggagacatcgtatgcgaccaccgcgtcaaattctaacccctttgcaaggtagattggcataacaatcacgccttgtggcatggtacggtcgctatcggccatcaacgttgttactgtatagcgcttcaggtattggtagacctgcttgctttctgctaaatctttagttagtacggcaacggtgttagttgccttgagctgatgttcaacttcgctacgcagactgctgagagcggcgtcttcgccatagcgaatcatgaccttaggtaaatcgcctttacgtgtgaacgcttgaatctggtcgccgtcgggtaatagcgctttagcaaagttcgtaatctgttcggtcgaacggtagctcttattcaacgtaatcaagttcgcccgtcggacattgaaagcatccttgaggcgttccagtaattgctgtggtaactcaatccccttgaataatgcttgttcactgtcacctaacagtgtgaacttagctagtgggaacgcgtgcttgatatataacagttgtgctagcgaatagtcttgcatctcatcgacaaagatatattgcatccgtcggttctgaccactgccagttaggacatcgcgtaataacaatagtggcgcgcagtcaaccagagcaatccgatggtactcaacggcggcctggtaagcggcaattcgttgttgccattggtcaggcgtcacggtggtgggccgatcaacttgcgctaagaaatcgttatattgttcataggtgtctaagaagtaaccattatagatcgcatcgtagacttgccgcactcgtttggtcacgatttgcttaccaatatagaagacttcatcgtcgagtgattgaaaatcaccacggcgcttggaacctaataagtcgtggtaagcttcgtcgctcaattggtcaatgatatcattgacccagtcagcttgggcttcatcgtcaatgcgatgctttaagcgtttaattaaagtgttcttgattgctaggaaacggtcagctggttgcatcgctgctggtaaggccgccgcaatctttgtaatgacctctttagcgaagaagatttcgccattaaagacgatgtttgtgaagcgtaattggtcggctggtagctgatggcaatattgatcgacttggcgcataaagtcggcgctttcttgaaaatcgcgaattgccggtgtcagttgttcacgctggcggtcactttcgtagcgctcaaagaggctttcaacggttaggccttgaaaacgtgcactgagaaattcggcaagcgtgacttgacgcatattgcgctcccctaaactaggtaagacttcggagatgtagtgactgaataagcggttgggcgagaataataccatttggtccgcttctagggaagcccgtgagtggtagagcagaaaagcgatccgttgtaaaatggcggacgtctttccagagccggcaaccccttggacaactagtaagtcactagtggtgtcacgaataatatcgttctgttctttttgaatggttgctacaatattttgcatgtaggcatcattttgttctccaaggacggcctgcaagatttcgtcaccgaccgtttcattcgtgtcgaacatattcttgatctgaccatgattaatctggaattggcgtttcttgatcagctcggtcgtctgctgcccggccggtgtttggtactggacctgacccagagtaccattgtagtagactgaggaaatcggggcgcgccagtcgtaaactaagaaattctgttcagcgtcgacaaatgaggcggtgccaatgtataaacgttcggcttcctcgtcgggactatcttgaatatcaatgcgcccaaaatagggtgagttactgagatctttcaagacaccgacttgccgtttcaagatggcttcggattccacggcgcgttcaaccatttgcttttgttgttgcagttccgcgttcgtttcaatccggtcatcgacttcaaacgtgttgacggaattattatcaccatagtttttctgaatgacatcggtttcgtgatgagcctttgccagcaagtcgtcggtctgttgtgcccgttctttaacttgctcgatgactcgatcaacccgttgttgttcgcgttgttgctcttgatctgatgttgccacgtagagggcctcccgtctgataatcgtctaaatcgcttgaacaattttaggcgggtttagggatgatgtcaatcaaagcgcctgcaaattcactgatttatcagtaattgttgtgaaatgtgattatgagtggcactaaggcgtgctagccaacggtgggcaagttcggcagccttacgatggcaaggctgaaacttgcaacctatgactatttattctaatatgattttaatcattctaataaagtgggtggaacgaatgcatgtcgcactagcacaacttaatattcagtttggagatccggatgccaactacgagcagattgaagtggccattcaacgggcagctgagcaaactgtcgacgtgatcgtcttaccggagatgtggaataccggttatgcgttaactcgcctgaatgtcttggcggatgatgatgggcagcgaaccttacaattactcagcaagttagctcggcagttttgcgtcaacattgtcggtggctcagtcgcggtcgctcgcgatgggcattactataatgagatgttagtcgtcgatcgtcagggacagttactgagtcgttacgataaagtccaccggtttgggttaatggcggaagaccgttatattactgctggtgagaccgagaacgtttttgaactcgacggaactgttgcgatgggggcgatttgttatgacattcgtttcccagaatggcttcgtaaacaagcagctcgtggcccccaagtgatttttgtcagtgctgagtggccgacagtgcggcagatgcaatggcggctattactgcaagcacgtgcgattgaaaatcaagcattcgtggttgcggttaaccgcgttggcagtgatcctgataatcaatttggtggtcagtcactagttattaacccgctcggccaaattgtggctatcggtggtgcccatgcccagttgattacggccgagcttgatttaacacaagttgaccaggttcgtggtcagattccagtgtttgaagaccggcgcccggaattatactgaagcgtaaattggggactggggctgggagcacttaactgaattttaatggtgttgaaggaacgcccgcttgaatttcgatgggcttaaacgtcgaaatgacgatcgttatgttgaaatggtagcggctagttaacgcgaatgatgcccagaatttattttgacacggtcaggtataaccagtacactagaactaattaatcgttgaagaaaagaacagtaaggcgtccaataacagagacctagcgcgtgctgaaagctggggcggactaatgaattggctttttggagattcggtgaacaccggggacccacccttatcggtcaatgagtggcagagacaagctttctgcaatttaggtggtaccacggtgatgcgtcctaattaactagtattagttgatcaggcgcttttttagtgccaatagaaaggatgaatacaatgacaaaaaaagtgattttaacgggtgatcgccccactggtaagctgcatatcgggcactatgtcggttcattacgtaaccgggtcgcattacaagattctggggactatgactcatacattatgattgcggataaccaggcgttgacggataatgcgcatgatcccgaaaaaattcgtaaaagtttattacaagttgcgatggactacttggcagtgggaatcgatccccaaaagtcaacgatcttagtccagtctcaaattccagcattaactgacatgatgaatcaatacttgaacttagtgacggtagcgcgcttgaatcgtaacccaactgtgaagacggaaatcaagcaaaaagcttttggtgaaagtgttcctgccggtttctttgtttatccagtcagtcaggccgctgatattacggctttcaaggcgacgactgttcccgttggtgacgatcaagaaccaatgcttgaacagacccgtgaaatcgtacggagcttcaataagacttaccaaactgacacgttggttgaacctgaaggctacttcccaccaaagggcttgggccgaatccctggacttgacggcaatgccaaaatgagtaaatcactaggaaatgcgatttacctttctgacgatgccgatactttgaagaagaaagtcatgtccatgtataccgatcctgatcatattcatattgaagatccgggtaaggtcgaaggtaacgtggtcttcacgtatcttgatattttcgatgaagacaaggccaaggtcgcagacttgaaggccgcctaccaacatggtggcttgggtgacgttaagattaaacgctacttgatggacgtgttggacggtgtattgcggccaatccgcgaacggcgtgcaatttacgaagctgatccagctcaagtcttacaaattttgaaggatggtacagcgaaagcgaacgtggtcgctgaccaaacgtggcgtgagatgcaagacgccattggaattaattattttaaataaatcatggtagaaaatagtgcaactgatcgtcggatgtgtgaagacggtgagttgcacttttttgtaggcccttaatatatggggctttccggtaaattaataacgatggcccaacgcatcacggttgctaattaaaaggaaaaggcagactaaattgaaaattaggctgatttcgtttgctttcttacatgaatgattgtaaaaaagtacttgttaaaataagtttttggcaagaaaaggggtggtaaggaattcgaaagcgcttgctgtggctgcctttagtcataatataaattcattggtataaaatcacgaaaaataaagcgttttcatatattctgtgataatataatttgtgggcacaagttttacaaccacctactaatttatcgaaaggaggtttagtcatgtatcaggcaattgcgcaggcaatcattaaatcgataatggcggatgaatatccgactaagttaccaaccgaaaaagtgttaatggcgcagtacaacgccagtcgcaatacgattcgtaaagcgattgatgtggtcttccggcatgggttgttgcgtcgtgtgcaggggagcggcaattttattatcaaacaaccgcagaacacgaagaaagtgctcaacttatcgattggatttgaccagtccgccatggttgagggtggaccattagtatcaaaagttgtcacgtttgataaagtgacagcggatgaaactttagcacaacaggggaacattgcgcttggtgacgaggtttatcgggtggtgcgattacgttatttgaatgacatcttgtatgacctggaagagtcttattttccgcgaacggtcgtcccgttcttatcgagtgagagcgtgcagcattcaatcttcgccttcttgcgagaggcatatggtattacggggagcaccacggaaaactacgtccatcaagtgcgggtggacgcgcaacgggcggagttgatcggttgcccagatggtgacaaaacgttgtgcttggaagcaatcaattacttggctaatgggacggtctttaacttctccaggacgttcttcgtctatccagatttggaactctattaccataccgaaaatattgatttacaaaactagtacggaggtgacgcaacagttgtgttgggtcactaactagcgaaaacctacattaggagtgaggggtatattatgaattcatttatcgaatggcttaacaaacacttagtgccagttgcggccaagattggtgcagttcggtggttgatcgcattacgtgacgcgtttatagcaattatgccggcaatgatggccgggtcgatcgccacggttctgaacgctttagttcgagatattccaacgaagttcggttggatgggcattgttaattcgatgcagtggttgattggaattaatgcgatggtttggacggggacgttagccatcttaggtctgattttctcatttacattcgggtatcaattggcaatccagtacaaagttgaaccagttactggtgggatcgtgacacttggaactttcatcatgagtttgccacaaaactttaccggcacgttgacgagtacgttgagcaagggcgctactaagattttgacggactctggcatggcggttgctggcaaaaaagtgacggcttggggttacttcaacttcaacacgtactttggttcgtatggtttctttacggtcatgattttaggggccattgcgagtgccgtttacattgctttgatgaagaaacacattacaatcaagatgccagattctgtgccaccggcagttgccaacgccttcactggggttatcccagccgccgctgcattttatgtcgttgggattattaactggatcttcagtaaattcaacaccacggtgattgaatggatcgcgaagattattcaagaaccactattgaatatgagtcaagggtacggcgccgtcctcttaatgacgctgttagttcaagttttctggttcttcgggattcatggttccaatgtcctggcaccaatcttggacggaatctggttgacggctcagcttgctaatgttaacgcttaccaagctggcaaagccttgccatacgtttggacgcggaactgttttgacttatatgcatggattggtggggccggctcgaccttactattattagtagcgattttagtatttagtaaacgagacgaccaacgttcagtggctaagttggcgattggccccggattctttaatattaacgaacccgtgatgttcgggatgccaattgtacttgacccaatctactttattccgttcgttttagcaccagttgtgactgtttcgatcgcctacgctgctttatcagctgggtgggtcgcaccgattacgaacaatatcgtttggtcaatgccaccgattatgaacgccttagttgccacaatggactggcggtcagtggtcttacaattatttaatgccgccgttgcctttgcgatttacgtgccattcgttaaggctgccaacaagattaaaccagcagcgattggagaatagattgtcatgaaaagcttaaagcagtgtttactcatcgggatgaaccttggattattagccgttatcttaagtcccctggccggaacgaccggtcaatgggtgacgctcggattaggtttagcggtcagcgcagcacttttcgtcgtttatcggcgagtgggtcagatagaaaggagccaccagaatgcagattaaattaactttgaacgcccctgtggattatttataccaacagttgatcgattccgcgcgggctgatattcagcagcaaacgggtcggccggcgccacggcagagcttacaaggctatgagtatgccaaacagtggtccaacggtctgaccggtaatttgaagattacccacgcgcaacccggtgttcgatatgcgtatgaattagaaacgccccgcgatcattacggcgtcgattatcaattcgcaccggacactgatggtcaccaaactgtcttagaatatgccgaaacctttttaggcaaggataagaagacgaatgccaataataagctcggcgtgctattcttaggatggttccgtaaacgccgctttaagaagatgatgaatcagatggctgctagttataatcaataagcaggctggattcaaaaattgatttcgttagaagagtgctgtaaatccgtaagtggatttacagtacttttttgaacagatatggtacacagcgtttcagatgtggtcgtgataccatcacgatggaacaagtgagcaactgcattgtaagcgcttttaaaacgcatgtagttcacttatactagcttttgtaagttaaatcaaagggaggaacaacttatgatgaacggttttaacgtgtttatggaaaaacacattgtaccatttgcagtcaagttgaatgaacagcgacatgtcgcggcaatccgtgatgcttttatgtacacattcccaattacaatggctgcatcgttagttattttaattaataacttagttttttcaaaaacggggtttattgcacaaatcttatttttacccaaattttttccacacttggaaaatgcccaaaagttattaacctcagtaactaacggaacgatgaatattttatcgatttttattgcgtatctggtggcacggaatttggccaaatattttaaagctgatgacatgttagtagggatgacggggattgcctgcttcatgattttatactcaccatcaattatcaaagacggtgtaacctatttgccaacgacttatttaggtgcacaagggctgtttgttgcaatgatagtaggtggcttagttggagaatttttaccacggctaacgcgcattaagaaaatgcaaatcaaaatgcctgagatggttccgccggcagttgcacggtctttcaatggcttaattcctatcgttattatgattatgctgttttctatgttgaactatgggttatcactaatttcaccacaaggaatcaatgatattatttataaatcaattcaaacaccattaacccacattggggtcaacttatttggcgttatcattattgctattgttcaaaatcttttgtggcttgtcggtatccatggtccaaacacgttgaacgcgttacgatcagttatttttactgaagctgatttgaaaaaccaaacgtttattaacgctcatggtacagcttggggtgtgcccaaccgtgcaacctggagtgtgttgaatgatgtcttcgccaatatgggtggtagtgggatgacacttggcttgattattgctatcttcctcgtctcaaggcgtaaagattatcgtgagattgctaaattggcattagtgcccggcctcttcaatattaacgaaccgctaatgttcggtttaccaattgttttgaatccaattatggcgattccattagttctaacaccagtgatcaatatcttggttggctatacagtgacagttatttttaactggataccgacgccggcttttggattgacatggacaacaccgggaccactgatgccgttcttggggactggtggcaattggcttggcctgattattggatttgtttgtttgggaatttccgtgttgacgtacatgccatttgtactcgctgccaataagatgatggctgcagatagtcaatctaaacaagatacggatacgacgacagaaacggttaaagcatagtttaaaaggagtttaacatgacgattaaaggacgagcgtttccagaagggttcttatggggtggcgcagtggctgcacatcaactcgaaggtggttataaagagggcggcaagggtctcagtacggcagatattatgacattagggacgaatgagcgccctcgtgaaattacggacggagtagtggctggcaagtattatcctaatcatcaggcaattgatttttatcatcgttatcccgaagatattgaattgtttgctgaaatggggtttaagtgttttcgaacatcgattgcctggacgcggatcttccccaatggtgatgaaagcgaaccgaatgaagctggattacaattttatgatgatttatttgatgaatgccttaaaaatgggattcaaccagtagtgacactagcacactttgaaatgccatatcacttagttaagcaatacggtgggtggcgtaatcgtaagcttattcaattctatttaaactttgcaaaagtatgttttgaacgttatcgagataaagtaacgtactggatgacttttaatgaaatcaacaatcaaactaattttgaatcagacggtgccatgttaacagattctggaatcattcatcaaccaggagaaaaccgtgaacgctggatgtatcaggcggctcactatgaactggtggcgagtgccgcggcggtacagttaggccatcagattaatccagattttcaaatcggttgtatgattgcgatgtgtccgatctatccgcttacagcagcaccagcagacgtcttatttgcgcaacgagcgatgcaaacccgattttattttgccgatgttcattgcaatggcacttacccacaatggttgcgtaatcgttttgagtcggagcattttaacttggacattacggcagaagatttgaaaattttgcaagctggaacggtagattatattggatttagctattacatgtcgtttactgtgaaggacacaggaaagctagcttataatgaagaacatgatttagttaaaaatccatatgttaaggctagtgattggggctggcaagttgatcccgttgggttacgctatgctatgaattggttcacggatcgttaccatttgccactgtttatcgtggaaaacggtttaggcgcaattgataagaagacggcagataaccagatacatgacgattatcggattgactatttaacggatcatttacgacaaattaagctggcagttctggaagatggggttgatttaattgggtatacgccatgggggtgcattgatttagttgcggctagtactggtcaaatgtccaaacgctatgggcttatctatgttgatgagaacgatgatggttcaggtagtctaaaacgttataaaaaggattcatttacttggtttcaacatgtgattgcgacaaatggtgccgaaattgagtagtgcgatttgggtatgacgatggtcattaattattgactagtgcttaattaatgatgtttgaaatagttgtcaatggccagctttgatagctggccattgggcgtttaggaggactgttaaatgacaatgtatattggaattgatattggtggtacttcaatcaagtgcggcctagttgatgctcatggacatattagtcgtaaagtaacacgaccgactgccacagcaaaggtagacattatggccgatttagttgcgatgattcaaggactacaagcagatggacaagttgctggtattggagttagcatgccgggagttgttcaaagtgacggcttcttgacgacggcaggtgcggtcacggcgtttgaaaaaattaacttgcaagctgagttacatgcacagacgcagttaccggtcattattgaaaatgatgccaacgcagcggctattgctgagcaatggctgggagtagctcagaatgtgcctaattatttaagcttggttcttggaaccggggtcggtggggcactggttatcaataatcagatttatcggggtgcacacgcgcgttcaggcgaatttggttggatggttgttgacgatgatgagattgatactgaaatgggaacccttaatttccggggtgcaacagttatcggtctcatacgacgttataatcagtttagtgcgatgccggttactgacgcgcgcgagatttttgaccgagcagatgcgggagaagtactgtcacaacatgtctttcatagctactattacagtttggctaaaggaatcattaatttaatggttgcttttgatcccgaattagtcgtaattggtggtggcattagtgcgaacacgacctttatgactgatttgaatgcaacgattgcagacttacaggctaatcataatagtattaatcatttgactttggcatcagtagtaccagctaaattgcggaatgatgctgggatgattggggcagtgtatcagttgattaagcgtggttaaaaaggcggatcaaactggtttattaaaatagggtgacacgtattttaatttaaaaaatgaaaaagcttgaatgctagatgttttttagaagcggttacgcatttatggtaatctagtgaatagattattagatagggtggtggctaaccgtggcattctttggctataaggatatcgataagttatctggagtagatttagcaatttatcgatttattgtggagcatgatgagcaaatcccgtatatgcgagtccgtgagttagcgcggggtgcgcacgtttctaattcgtcagtcatgcgctttattcgtaaaattgggtatgatagttttccagaatttaaagtatcgctacgcagtgaaacgcccattcaaaagccggatgctccaggtattcagtttgttcaaccgagtgcctttcctgcagatattactaagattattcgactggcagctcagttgatggtcaatgcggataatatcgtgtttgttggtatcggagcatcagcggcgttgggcgagtatgcttcacgtcaaacgtcatcattaggatttaatagttatgtcgtcaaggatcctttctatccactattaccacaattacgtaatactagtaataacgttttggtggcagtgtcagtctccggtcagacgtctgagttggttgaaatgcttaatgactttgtgaataatcctgaagtcaatattattagtattacgagtaatcttgagagtacgattgctcgaatgagtcgatatgcgttaacgtatcgggcgactgaggagcgtattcatcaatattatgacttaactagccaagtgccatgcctttacattattgaggcactgttacgggaacttcgtcatcaagaagtcgtccaacaccggtttgagtaaacttttaatttatttagccagcaaacgtcattcctgcaaagcaggcatatcaatgctaaaattaaaagcattcaatccaaaagttaaactagtgataagggagtatgagaacgtgacagcaacaccattctggtcgcaaattgcggcccaagccaaggcagacgggcgaccattttttacgatggccccgatggaagccgttagtaatactgtttttcggcaagtcattagccattccgctgctccagatacgttttttagtgaattcgtctatgctaagagtattacgaacccgaatacgaagtttccggtgcatggtcgtttgtacgtggcggcagctgagtcgcaaaaaccggtcgttcaactgtggggtaacgaagcggctgactttgcttcggctacagctgaacttcgtgaccggggctttgaagcagttgatatcaatatgggctgcccggatgggacggtcatcaaaaatcatggtggcagcgatttgattcgcaatccgcagtgggctgaagacgtgattgcggctgcaaagacgtcgggactggccgttagtgcgaagacgcgcttaggttacagtaaagttgctgaatatcatgactggattgcaacgttgttatcgcaacatgtggcagtcttgaccgttcacttgcggaccaaacaggaaatgagtaaggttcccgcgcactttgaagttgtagatgacttgattaaaatgcgtgatgcaatcgccccggaaacgttactccagattaatggtgacgtggctgattatcaggccggggtggcgttagccaaagcacatcctggattagatggtatcatgattggtcggggagtgttcgcgaatccgtttgcatttgagtcccatccccaatcgcatgatttgcatgaactattaggtttactgaacatgcagctcgacttgttcgatgactttgccacccgttatgacgtgccacgttttccgtccttaaaacggttctttaaaatctatgcgcgcccagaactaggcgccactgacctgcgtaacacgatgatggatgccaagtcaacggatgatgtacgcaaaattttagcggcttatcaagccaaaatgcgggtgaccaatcacagttagtgtcagcagcagacaggttgattaaggcagtaatacgttaataaacttcaatcttattatatagaaacatctcgatatcggcagtgagtgctaatgttgggatgtttttgtatctaaaggggtatgacaattgtattcaaatcattggaggactgattgttcgcctgtcgccaagctaatctggatgcttgtaacatcatttacaatgattgtaacgttgtcatcttatcaagaaaaccatgttacaagcattcgttactgccaactagctagtctaatgaacccaaaatgaacggccctagtcaaaacactagcgtcgttcattttgggctttttgatattttttggtgtgcaatccggccctagaagtcacagtgttacatcataaatgttagaataaacctaactaatattttataaacgaaaagtgagcgtggtgttatgagaaacttagcgattgtggatttagggtccaattcggcgcggatggcggtcagtcggttgcatgctaacggcactgctcaagaaatcaagcgtgttaaggaagatacgcgtttgtcggaaggaatgggaacggcacacgtactccagccagccgcaattgagcgaacaatcaaggcgttactcaattttcgccgactttatgaaaaaatgcccaatacggatgttattggcatcaccacagctgcagttcggatggcacaaaatcaggctgaatttctcaatcaagtcaagcaagaagtggggctcgatttacgagtcttatctggtgacgatgaggcctattacgattatcttggggttgccaattcattggtcatccatgattgcctaatcttagacacgggtggcgcaagttgtgaactgatcttggtcaaaaatggccgcaaacagcaactgatcagcattccatttggcgcggtgacattatcggaacaattcggtctcgacgacttagtgccgtctgcgagtctatttcgggcgcagatgttcctacgtaaccgactggcagatatttggtggttatcagaagcagtgcacttcccaatcattctattgggtggtgccaaccgaaccttagcccgcattaatcggcgccggcaacaaaagttaaaagttgaagatattcacgggtatcgtctgaagacagagacggtgttccacacgtttttggacttactgtcacggtcgaaaaaaggtcgccaggaaatttcaggaatggaatatgatcgtgcggacattattgttggtggaatgttaccgctagtgacgttattacagatgttggatagtgatcgggtgatcttttctgaaagtggtgttcgtgagggaattatttcagaacacctcaatcaataggtcggttcggtagatgagtcgaatggagagaataggaatgagaatatgacagctgattttcggcacttttatcaaaaaaattgggcggaacgcactgccatcgtagcgcaacaggcccatttaacgccagctgaacaggcgttatttaaacaatattatttaccacaacatcatgaaattattgagaattatttgacggattacccattaccgatggggttggctgtcaacttagtcgtcgatggcgtggatcacattgttccaatggttactgaggaaccttctgttattgcggcagcaagtaatggcgctaaaattgtcaagcgtgcagggggcttcacgaccgtccttaatcaacgtgaaatgattggtcaaatcgttctggagcagttgtctgatccggctgcaaccgctgccgtgattgaagcccacgctgcagcattattaaaagtagctgatgcggcccatcccagtttaaaaaaacgaggtggtggcgctcggcgcctacgtacgcgtgttctcggacaaggctatttatcaattgacctattcgttgatgtgcaggctgctatgggggccaatatgctcaatagtatgttggaagccgtggcaaagtccatcggtgtgatgacgaagcaggacgctttaatgagtattctatcgaattatgcaacggcgagcttagtcaaggccatttgtgacattccggtcggattattacaggctgggcggtatgccggcaaactagttgcccagaagattgcgtcggccagcacggtcgctcagcttgatccgtaccgggccacgactcataataaaggtatcatgaacggtattgatgctgtcgctattgctagtggcaacgactggcgcgctttggagagtggggcacacgcctatgctgttaaggacggtcaatatcgtggcatgagtacttggaccagtgatggtcggatgctgcacggtgaactggaattgccactaccggttggcattgtgggcggttcaatcaaaattaacgagttagcccagttgaatcaacgaatattaggtattcaaacagcgggtgatttggaaagaattatggttgccatcgggttagcccaaaatctagccgctttacgcgccttggtcacgactggtatccagcagggccatatgcacctacagttgaaatcgctcgcgatggcagcgggagcgactcctgaggaactccccgttatcttacaacgacttgaattagcatctcaacaagacctcgcaaccacgcaacaactcattgcggaattgcggcaaacaaaggaagagactgatgactgaaattaaattgaaccaaactgttacagatttattaagtaccgccaattcgttatatccgggcaatattagtgttcgttttggtgacacaaaagcgggttacgtccgccatgatcaagcacaacaagtgttagatgatggtgacctgaccgttcgggttagcgatattacggctcctaattacacagcgtcacatgaattattacatctattattgttattacaaggctttccacagattacctttaatttaaccacgcgtgatcaacaactggacgaacaattgatggcaatcgctatggaactttatgacatggtgagccacgtcttggtcgtacgcaaacaacgggaacataacttaatcgatgagcaaattgaaacgctatacatgcaaggtgtggcggccacaatcgaaccggaacctgcgggcaaggcggatgcgatgatgacgttacggttattaacattgactgacctactcgttttctttaatggtgaattaccagctgatgatttgcaaaaggtgacaacggcctatccacaagcttggccggctgcacagaagctatacgccgtaatcagtcagaagccagttgacaccccgtttgcgatgcggcgtgccgtagtaaagctgttcaaggcttttgatgatcagatgacggcttggcatttaccagtcctacacggaacggaatttgtgaccgttcagagtgtgctcagtgaacggcaagagcggctggaagtccggcagttatttgacgtttaccattcagatctattagataaaaataaacatacccgagcgtacattgggttatataagagtgaccgtcagaatgcgtttgtcctaccagcaccggcgcaaaagaagagcgatgcctttttcaaagaggtgtacgataagacggtcaaagaattattccaagaaatgaatctaccctatacgttacggtaagctaagcagggagatgtcagaatgagtgacattacagcagcacaaacaactttacaacaagctcagcatatcgtttttatgacgggggccggcgtttcgacgccctcgggaattcctgattaccggtctaaaaatggactgtataccgaacaccataacgcggagtattatttaagccacgcgtttttggcggagcatccgctggaattttatcaatatttacaatcaaatttatattatccagacgcccaaccgaatgtgattcatcaaaagatggcggcactgactcagcaagggcgggccagtgtgattacacaaaatattgataatttatatggggtggctaaaacggctcagctcgttgaatttcacggtaatctctatcaggtctactgcaccaagtgtggtcagcatgtcgattggcatgagtatttgaagtctccttaccatcagacagaccatggctacttacggcctaacgtggtgttgtacgacgaggggattgcgagtgccaatatcgaacgggcagttcaatatttacagcaggctgacctagtcgttatttgtgggacctcgtttcgggtgtacccgttcgccggcctaattgactatcgtaatccgaaggctcaagtgcttgcaatcaatgcggaaccgctccagttgccatttgcatttacgatggtgcaacaagatgcggtcgacttcttcgagggggtgcaggtctgatgataacaattggcttaacaacttggacggaacaccctagtttactgggtggtactgaaaagctgaccttaactgaatattcgggagtcctaccagtcgtcgaagtggacacgccattctatggtattccgaaagtgacgacggtcgcgaagtggcaaaaggccgtccctgataagtttcagtttattttgaaagcaaatcaggtgatgacgctgcatgacacttatgacgaaggggtttcgatggatgcgctaaagacagcttatcgggaataccgtgcgatgctcaaaccgttaacgcagcaccagcaattaaaagcggtgctcttccaatttccgccgttttttgaacggtcgaaccgcaacttccattacctacaacggatggtcgagtggttacccggtgttccaatcgcagtcgaatttcgtaaccagagttggtacgaggagagtgtcaaagatgcggtctttagttttctgaaggatctggggattacccatgtgattgtcgatgagccgcacgctttaaatgatggcgttagtttcgagccggtcgtaacgaattcgaaattggcactcttacgcttacatggtcgtaaccagcagggctggtcagccaagggcgctaactggcgtagccaacggactttatatcggtatagtgatcaagaactagctgaattcaagcaaacggtggaacagttacaacagcaggcggacgaggtttgcgtcatctttaataataattctggtggtgacgcggccgataacgcgatggcactcaaagagttgctaggcgtttcgtttggtgatttaggaccgcatcaactggacttgttttaaaatgatttatgagtgattgatgtgatactttgcttaattgaacgagttatcagttgaattactatgttggatcaatacagtcactatgaccgtgaaccgttgaaatttggtagtacggttgaatattctttaattgatgaatcatgacaactaaaaatgtagcggtagttcggacattcaataatgtgagctgccgctacatttttttgcacttacaccttagttaatcaatatggccttagccatctgatttgaaagcgaacggttgggatacatcatttggaagtaaagttagtgtaaagtcaagaagtagtttatgtaaattcctgtttagttttggtaataattatctcgttggtcgtggatacgatggcttgggactgccttaaaactaggcagttataagtaccttaattcatgattcttaggtgaattagggtgattgagaaaagtgcgtgattaagatacactgacttcagttcaagcaactaagtagttgcctgccactatgtgagttgcagatagttatggcaggttgaagtgttgttgagaatcgaatgttaggtcataacaatatagattggggcggattgggtatgcaaccggatattatttgcgcaaatggggttttctgcgctgatggaaaagtcttattaacacgggaatcaaaaaacacagcttattattttcctggtggcaaggtcggtgtgggagagacgctaacacagactctgcagcgagaattaaaagaagagttgtcattagttgtgtcgccagatcggtttaagtgggccttcacccaccgtggtacggcctataatcaaccgggaaaaatagtcgagttaaattgttttttagttgcggggagtggcgcgctcaaagtcgactcggaagtttatgattataagtggtgtcggccggacgatagccggatcgcggaagtcgttcgtgaagcgctggcccgatattcgtgggttgttgaataataatagattaccaataaatgaccggttaaaatcaactcgtgattttaatcggttattttgtggtggttggttgggccatttgaagcatggtgcacagttgactagtctgccacgatctttgcgtgtggagaactcttttgttagtgtttcttaataaacacaggaaatatgatacaatataagagattctacacattggcccagcaacatgttattttagaccaagacgtgttgtttggacgcgtgtgatttgttcatggattttaatcaaagacatgcttaacgagttaatcataaaccagtttgaagggaatttacgtcatggcagaaacaaaaccaacttattatattacgacgccgatctactatccttcggggaagttgcatatcggtaattcatacacgacaattgcgtgcgatactttagcacgttacaaacgtgcgatgggttacgatgtttacttcttaaccgggacggatgaacacggcctcaaaattgaagaaaaagcagaaaaattgaacactgatccgaagtcatacgttgatgggatggcaaaacaaatcaaggatttatggcaattgctagaaatctctaatggcaagtttattcggaccaccgatgattatcatgaacgcgcggtccaagaaattttcgatcggttacttaaaaatggtgacatctacttaggtgagtacgaaggctggtactccgttgatgacgaagaatacttcactgaaacgcagctggctgaagttttccgtgatgataacggcaaggttattggtggtaaggcgcccagtggtcatgaagtcgaacttgttaaagaacagtcctacttctttaagatgagtaagtacgcagattggttgttagattattatcaaagtcatcctgactttattgaaccagctaatcggatgaccgaaatgatcaataattttattaaaccaggtctggaagacttggccgtttctcggacgagctttacttggggtgtccctgtcaagagtgatcctaagcacgtcgtttacgtgtggattgatgccctgacaaactatattacggcactgggttacgcaaccggcgactccgaagacttgtttaacaagttctggcctgccgatgttcaaatggttggtaaagaaatcgtgcgcttccatacgatttactggccaattattttgcatgcactcgggttaccattacctaagaaggtctttggtcatggttggttattgatgaaggacggcaaaatgtccaagtctaagggtaacgtgatttatcctgaaacattggttgaacgttacggcttggatgcgcttcgttattatttagttaaagccatgccttatggtaacgatggtttattcacaccagaggactttgtggcgcgggttaactatgacttggctaatgacttgggaaacttgctgaaccggaccattgcgatgatcaataaatatgaagatggtcaattaccagcattcaaagccggtgtgactgaatttgacgctgacttagaagccacagctgccacgactattaagaacttcaacgcttgcatggacagcctgcatttatcagatgcgctggctgaagtgtggaagttggtcagtcggacgaataagtatattgatgaaacggcaccttggcaattagctaagagtgacgatgcgaatgatgctgataagttagccagtgtgatggcccatttagcagctagtttgcgggtgattgctagtttgatcagtccggtcatgacgcatgcacctaaggaaatctttacccaattagggttggacccagcaactttagcaattgccgacttacaactggctgatttgccggctggcgcacaagtcgttgctaagggaaccccaatcttcccacgggtcgatatggatgccgaagttgaattcttgaagggtaagatgacgaaatccgacaaacagaaggggcgtaaagccatggaaaacgcgaaacatgaagctgaagtcgaacaaggctggaacccagctgagactaatttgaacctcactaaaccagcaattaccattgatgattttgacaaggtcgaattgaaagttgctgaagtcattacggtgcagaaattgaaaggggctgacaaactcctacaattccgtttagatgcaggagatgctgatcatcgccaaatcctttcaggtattgctaagtggtatccagaaccggaagaactgattggcaagaaggttatcatcgttggtaacttaaagccacggaagcttcgtggtgaaatgagccaaggcatgttactgtcagcagaacacgacggtcaggtgcaattaattacggtaccagataatatggtaaacggttcattgatttcgtaagttattaacgaagtattaatgtgagccgaaaataaagaccgttccccaatttgtagatagttggggaacggtttttgatattattgaattaattgctttgtgtagattttgaactatgagcgtttgatgataggaatcgagatgtaattcgtagtgtaggttacaagcgtcgaatctgtgtttcactttttcccctgatttattcattgggtgtttttgtgaataaatcaggggaaaaagtgaaatttaagaagtttaaaagcttttggaatgatgcgctattaggaagtgtagctagctcggcttcagcgctcacgtataaatttcttaggaaatgtagagtgccaaaggtaattgctaagtcagcttctgcggttgtttggagcgtggtctggtggtatattagttgaaattctaatcgatagtggttgcatatgtttgatgttatccataattatatttttgaatgctggaggacagtactttatgaaaagagaaacgatctaccaactttcttatcatactttttatatgattatttgtgcaacgggcatcgcagcacttgccatctttgttgcccattggtggcaagtgctggtatttggcgtgatggtaggtgtcgcttccgttttacttaggacacttcttgaacacttgaacgttgtaaaagctgatcatcaggtgcagaaaattccaaaatggctgaaacttattcagttggtggtactgttagtggtaatggttttaacaacggtattcaccattcgtacatggtggctggcgctactgattgggatgtgtgccggaattagttcgcttctaattgaattacttgctcatcgactagtgccaattaattagtatttcatcattaggacgtatgtgatagttgctgattagttacagttaatccgtatcctgatttcttaagacaagtcgggtacggattttttgcgaggtggaaacagtcaggttcattcgaaagtagtgcgttttgacaaatggattaatctcccgtacagtagtacgaacaagaaatgaggtgagaacatatgaagtatgaacagattctcgtatgcgtctccgtagatggaaaaggacgtttttccgtaaattaattaaatttaggagacttaattaaatgaaaaacgtccaaaaacaagtgccatcattattactgttaatcacattagtgggttttccacaaatcagtgaatcaatttttacgccgatcttgccagcactcagtcaggcaatgcacgttagcgccagccacagccagctaaccatgagcagttattttgtggcttttgcagttggggtgctcttctgggggcaatatgctgactatcgcgggcgccgtgatgccatgttaggtggattagccttttatttgattggtaacttagggttatatctgagcccgggctttacttggttattggtttgccgcttgatccaagctttcggtgctagtgctggttcggttgtgacacagactatcatgcgtgagagctttacgggtgttactggtgcaaaaatctttgcgaaggtgagtgcggccatggcactatcacccgctctcgggccactcatcggaggtggcgtccagactgtgttcggctatcagcatgtcttctcggtcttgatcatgatagcagtcgtaatactgttgtacgcggggtgttgcttgccagagactcgaccagaaacggtcaaagtggcctcttggcggcaacaaagcgttgtcgtttcacggttattgcacgattccgtggtctggtgttacggcctattgattagtggtattaatggtattttgtttagttattacgctgaagcgccgtttatttttgaaacgcacttcggctttagtgctgtgcaatacggtagtctcggtttagtcttagccgcggccagtctgctgggcgcgttgctagtgaattggcttgtcaactattggtcaccaatgcaggtcgctttaagtggcttaggattgagtttggtagcggcagttggcttggtgatgaccgctgttggcaatcacgtcattgggatgctgattgggatttttctagccttcttaggtctgaacatcaccctaccaaacgcgttgaatcgtgctttgattggctatgaaacggtgatggggagtgccagtggctggtttagcctgggttattatctactagtgagtgtgctaacttacttaatgagttggctccaccacggtagtatcgtgacattgcccgtatacatgttaggcgtggtcgtcgtgatgacggtggtgtatgcgggactgtattggcggcgtgtacgtcattaattttgcttgaaagcttggggaaacccaggctttttatattggcattgtttttaggtccagtaagacgttttgaaaaatcgtgtcccagtattggatgtgtaaacagtgcacaatatcaagtgcttgactacaggcgttcaatggctggttgggcttagtcacgtagtccgtaatgccctgacagaattttagtagtaatgctgggacgagttggtcagagggaaagttgatcgttgtcattataggatatattttagtaattagcttgggctgtttatcgtgaatagcaacgaacagctggttggctagaaatgtcatgaaggttaaagcttcgtcagtcaaccgttgatatttgtggaaacttttattagcgcttgttaataggatgatttgctgctctggcgtaagagtggtgaagatttggcgacataacatcaaatcatatttggaccacagttgaagattcaataggtcttgaataagcccgtcaatcgctgctcgtaacgttgaatccagtgcctgttgtggtgtttctaggtggtgcaaagccaggtgggttagcgttagtaactgttgataacgatgagcatgcgttgcattaaatagcttgtcaatttgcttctttaatttccaaagctcgccaatatcttctttggcgactgcgttttggatttgttgcagcaattgttcaaccgggggaatttgatagtgatgtaagatgaagtcaaattcctgaagggtaagttctaaccgctctagtagctgtaaaaagcaaacagccgaaatgttgctgtgaccgttgatgaagcgatagtaagttgactttgagataatgcgttcattgttagtaacatcattgactgatagtcttttagcatgctgaaccatcttgacagttgcaccgattgaagctgaattagacaaactggacactcctaaataactggatttgctgatgatttcccatatctgggaatttttctcgcttagaataattaatgtgctacattaaactgaacgaatagttaatgtggtgaattgaacattgcgtgtatcgttatctgatgattttgaacattctattaactattattgttttatgttagttgatggaattaagcattgaatgaaaaagattagaataatgtatgaatttttgaaaagagtactttgtgttaaagcaggtgaatgttagtaaccataacactgaggtgttgttactgaaaagtgtcgctattgaattgagaaaattaaaaccagtaattttgaatatcgttgagatgggttattggttttaatgaatatactcaaatttggaagatgtcaaaatatgaaatgttagcgcagatattgactttaaactaaattattcttcgaaaaagtcacaatacataataaagattgtttgaagtcctctcagcggttataaagtttaaattgatagtctccattcagcatcgataatagtttttgtaagggtgatttgatgaagcgctggaatcgattattacaacgtattcaagtaaaatatggcagtttatcagagcagcaattgttaaaaatcaattattggttattagcaatctacctagtcttgtgtggcgttgcctacattcggcgacgtcattcccacagtgctatgctccaagttgtgccggaattaataattaccctattggcatttggattgttgcgaataattagatggcgaaaaaccacgcctaagagtcggtttaagtttgcgactgaggattattcaccagaagagcaattggttatggtggcagttgtttttattgaaaactttccaatttctgcgatgttggagatggtcagcaatattttaattgttttgattggtattcgaaagtttttgcaatataaactggaccgattatcagcgtatcgaacgttaaatattatcctggtttttgaagctgttatggttagctggatcgtcctatttggtggataaggcagtgctcgtcaatgattggcatgggctgagattgaagaaaagtactgtgaatttttgtcaatcattctagttagaatatagttagttaagagggtgcctagtgcagcctctttttatggctaatgactagtatgtcgttattagtttgcaagaaataggttggatggcccgtcttcttttccgaaaacttgcgtcccatggtaaaatcaactaagataacaaaagtcgaaaaggggttattacatgcggatttttgattctcatacccatttaaatagtgaagaattcatccaggaagtgccacgttacttacaacaagcggccgaccttgatgttacgcggatggcaatcgttggttcgaatacacaactgaacgccgatgcgattaaactggcggaaacgtatcctcagttagtcgcgattgttggttggcacccggaagatgccaaaaactatgatcaggcggctgaaaagttgttgattgaacaagtccaacatccgaaagtcgtcgcgttaggtgagattggactggactaccattgggatacgtcgccacaagacgttcagcggcaagtctttgcccgccaagtcgccattgctaaagagatgcaattgccaatttccgtgcacaatcgtgatgctttcgaagatacctataagatcttgaaagcagctgatattcgtgacacgggtggcgtcatgcatagctttaatggtgaccctgagtggctcaaacggttcttggacttaggtatgcatatttcctatagtggtgtcgcatcatttaagaatgcgcgtgaagtccatgaatccgtcaagcaaacgccactaacgcaaatgctggttgaaacggatgccccttatctaacgccggaaccataccggggaaagcagaacgaacccggttacacgcggtacgttgttgaagcaattgccaagttacgtgaaacgacgccggaaattatagcggcccaaacttatcaaaatgcagaggaattttttaagattgaaaaagattaaagaagtaattgtggttgaagggaaagatgacacgaagcgtctcgccctagctgtcgatgcagatacacttgaaacgaatggctcggcgatttccgaagccaccttagctcagatcaaaacgttgcaggccagtcgcggcgtgatcgtgttcaccgacccagacttttccggtgaacgtattcggaagacgatttcggcggctgttccgggtgtcaagcacgcctttttgccccgcaaagctggtgtaccaactaaggctggggggagcctgggcgttgaacacgcgagcccagcggcgatccaaactgcactcgcccatctatatacggagcaaatcgacgagccccaacagttgatcagtcaccatgatttgattgcggcgggcttactagctggtcccacggcgcgtcaacgacgcgaacagttgggtgaacgtttaggtatcggatacgtcaacggtaaacagctgcccaaacggttacaactatttcaaattcagccagctgatttttgggcggctgttgaccaactaaccacagaggagaaatgatgagtagagatttagatattgcgaatcccgcccgcacacgggcaattatgcatacgtacgggttacaagttaagaagagtttaggacagaattttttaactgatcagaacgtgttacacaacattgttgccactgctgacattggaaccaatgataacgtgattgaaattggccctgggatcggggcactgactgagtatttggcacgggatgcgcaccacgtcctggcctttgaaatcgatgatcggttactgccaattttggatgagacactagctgattatgacaatgtaacggtcgttaaccaagatattttgaaggccgacttagccgcgatgatcagtgaacatttagataacgagcggccgttgaagctcgtcgccaatttaccgtattatattacaacgcctattctgatgaacattttggcgggggacgttgcttttgaaaatattgttgtgatgatgcaaaaggaagttgccgaccggttagcagctgaaccgggtacgaaggcgtacggtgcgttaacgattgctgtgcagtaccggatggctgctgagatggcgatggtcgttccccggacggttttcgtgccgtcaccgaatgtcgattctgcaatcgtgaaattgacggcattgccaccgcggacacacgtgccatttgacgaagcagcttttttcaaggtcgttaaagcgggctttgcgcaccgtcggaaaaatctgtggaataatttgcaaagcctatttggtaaacaacctgagacgaagacggccattcaacaggctcttgatatcgcgacgattgatcccaagattcgtgccgaacggttgacggtcgatgaatttattacattgacggatgcgttacatcaggctgacttactttaagttatctatgcttataaaatggttgcacattagaaaaccttgtgatataatattgacttttttgtgaaaagctagtatagtgtctttcatgaggaggattctcaatgccaatttcactagctgcaattaaagataaacttgactcacggatcggccaacgcatgaaggtcgttgcccaggctggccgtaagaaaacaactgaacgccacggtatcttgaaagaaacttatcgttcggtgttcgttgtggatttagatcaacaagaaaacgcatttgaacgggtctcctacagttatactgatgttctgacaaagaacgttcaaatcgcttttgatgatgaaacaactgaagcttaattcgcgtctcgtgaattctcaatattaagacccccaagcaaggtctttttattttgccttgatattagtataattgtatcaaagtaagtcagcgaccccgggtaatcgcggtcatggaagagggtgagacgcgtgcagatcgttgaaaaagcaccggccaaaatcaatttaggactggataccttatttgaacatccaaatggggataaagagtgggacatggtgatgacgtcggtcgatctggccgactatgtcatgttagaatcattgcatacgaaccgaatcgaagtggtcaccgatagtggctttttgccgaatgatcgccgtaacttagcttttcaagcggtgagcgttttaaaacggtattgtcatgttgatcggggtgtccgtatcaaaataagaaaggccattccggtagcggctggtctaggaggcggctcatctgatgccgccgctgttttacggggcttgaaccggatgtggaatctccacttggacttagccacgttagcacgtttgggattgcaagtagattcagatgtgccatactgtgtctacagtcagacggcccacgtgacgggaaaaggcgatgtagtcaccccgctacctaagttgccgccgatgtggattattctagcgaaaccgaaagtcagtgtgtcaacgccaaatattttgcggcaggtcaattacgagcgtatcgaccagcatcccaatattgaggccttgttgactggcattcaacggcaggattttgcgaagatttttgcgaatatgggcaacgttttggagccaattacggcaaaacgctacccagagattttacagattaagcggcaattgttaacgtttggggcggatgcggcccagatgagtggtaccggaccaactgttttcggtgtgtgtcgcaaacaatcgcgagcgcaacgagtgtataattccttgaagggtttttgccgggaagtataccttgtgcggccagttaatttaaatgaacattagaccgcagtagtccgccgtgatggtggactttttttattgatgcggggttgaatgagccgagtctctagtttactgccacggttaaatggtagcgctgagccatttgttatcacgacctgtgtccagccagagatggtgtggtagtacaattggcacaggaacgcgagtagccgcggctttgcttgcagattgacacacgaaaatgatcgttgctttcaccgtgtaatcggttattcagacaacgcaatctctttttgtaagcaatttatgcgcgtttatgattaaataaggagtaacggaggtgttcggatgaagcagtcgacaaaatttggattgaaactagcgggcgtcgttggtgctgcaacttatgcgggaacgttacttggtggcttagcggcgtatcaagtcgcgatgcacgtgagtgacgcacagaagcagcggggccgcgaacgttcgcgggcagaaaacactgaaattgagaatttttggtatttcaagcagcctaaacagcagtggatgatccagtcctttgatgggctgaacttagtcgcaacatatatccctaatccgaaaacaattggccgcttggcgattttggcgcatggtctaggacattcgcgcgaacaaatgattccgtatgcgcgcatctttatgagcttgggatatgacgtcttgatgcctgatgctcggtcatttggtgatagtcaaggccatacgattggttatggttggctagaccgactagattatgaacgttggattacgatggcgcttagtcaattaggtctggatattgacatcgtattgatgggaatttcgatgggggccgccacggtcatggcgactagtggtgagccgttaccggagaatgttaaagctattgtggaggatagcggttatgcggatctttatgatgaagcgaagttcagactgactcataagttccacttgccagcctatccgattatgccggtggcgaatcgcttagcacacgttcgcgcgggctatgggtttaaggatggccggattctgcaacgggtgattgatggtgggttaccgatcttgatgattcatggttccaaggatcagacggtgcctgtccgcaatgcacataccttgtacgaccagctaccccaacaaaagggcctgtatatcgaccccgatgctggtcacgttgaagccatccgaacgcacccggatcgctatcaagaagtgttggatgaattcttacatgagcaggcggggttggcttaagcccccttaaattaaagtaataataaacatgaattgagcgtgttttaccggcttaacggtaaaaacggtctttttttgcaatctcgtcttagtgacaagcgcattcaactagtggtcaaggtgttatttgattaggcccccgatgattgccatggctggtaatgattgcggcattttgaactcaggtattgacaaatcaccgcattcaggtaaactaaaatagtaatcattacgatttactttaatttagaaagttggggtagtgttatgacggaaccgttaattgccgtccaacaccttggaattggctttccaaacaaccaggtgtttaaagatttgaattttaacattgaacaaggtgactttttgaccgtgattggtgagaatggggtggggaagaccactttaattcgcgccttgcttggcatgctgaagccaacagccggtcaaattaagtattatccgaataaaaaagccattaaaattggctatgtgccccaatttcgcaacttagaccaggagtatccgttaacgattgaggactttgtcgggctgaacctaaaagggtggcagccgtggctgtctcgagctgaacatcgtcaggtagcgacagcattagccgtgaccaatttgaagaaactccgtcagcgaccgcttgggatggcttctggtggtgaaaagcagcgggcttacttagcacaagcaattgtgcaacaaccgcagctattaattttagacgaatcgacggctagtttggacaatgaaatgaagtatgaattgttggacctcgttcagaacttaaaccaaactagcaacattaccgtcttctttgtgacgcacgacttgccattagcgaagcaatacgccaaacattatctggccttaaagcccggccaccagcaatttggcaatatcgctgatatgtcggtagagcaattaaaggaggccactaatgtcaatgtttagcttagtatttatgcgaaatgcctacttagcaggaacctttattgcaattatttgtgggacgattggcgttttcgtgattgcccggaacctctcatttctgacacacacactgtctgaaattgggtttgccggtgcagccttcgggatttttatgggctggaccgcgttgagtgggatgctgatttttaccgtgattagttcggtcatcgtggggcagatgagtgtgaaacaatcacgacgcgaagcctcgatttctgcaatttccgctctgtttatcggcttagggattctattcctgtcgttatctaatcaaacttcgagttatgcgacgagcatcctgtttgggagtgtgattgggattgccagtgcggatgtcatccgggtcgcaatcttatcggccatcgtcctactcgtgatgttgggcttgtaccggccactcaaatttgattccttcgatgcgattggcgcccgggtgagcggcttatggacgaccggcatctcagtggtcttcttggtactcgttgcgatgagcgtcagcgtggctgcccaaattgtggggtcattactgatctttatcttactcacgttaccagcagcggcagcgcgatactttgtccatacggttagcaagatgatttttctagcgattggtttcgcgttgattggggtttggctggggctgtacttgagttacgtcacgaatttaccagtcagtttcttcatcgctgcaatcgagtgtatcttctactttgctgcgctgggttatcagcgacttcgggtcggaagctagtggggctattcttgttcagctgtatcacgttaaaagtaggtagtttacagaattaagtggttcgttgtgacacgctaaaatgttactagtcgtttctggaattcattgggaattctagagcggctagttttttgttcgtgttggggttgcaacttttcgtttgcgtggggggcaagtcacacaagaagtcttctaaaagcataagtccaagggtagcgctgtaattgccacacttagtcgtaggacgggaatcagtaaaggtatcatttcgtttttgacggatatgattgggtataatgatatttataccattattacggggaaagatgcgctactggtaagaagcgttctcgtttgaagggtgcgttttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaagcccaaaaaagacttctcatgcgacaaaacacaagaccaagaagcgcaacagaagcgctacaataagaaaaaaggctgcgggcaaggcaagaaaagcttctcagagaaaacaatcctcgcagaataaagatagtcatgggaaaaaggagaaatctagcaaggaaaaatcttcaaaagatgggaaagataaaaagacaaataatgtcccattggaaaatggctcttatattaggaacggaaaaccttatggacgaccaacattaaccgggaagaaaaaactcgaattcgagcaggaagtatataataggcaagctaaagatggagtgcttattgatcgaaatacgaaacaagtgatacattggaagccgggctaaccccgaaaaggaaaggtcgatctcggacatctaccgggtaagtcttataaggaaatgttcaatctatataaaaataggaagatgacattgaaggattttcaatttaatcccaaaaactctagattagaaactccgtctgctaatcggagtcataaatatgaaacgaggtaaaaagtgtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactgattttttagatattgtaaaagagtatgaaaacggcaaaaaatgattgcaggttgaaaaatggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaacatgaattagtcagattaagataaccgatattcgacaaggactaattgccgagtatcggttattttatagaaaagtttagtcggtaatttggtaattactgttgtctatatcctattgtttggggacgacaacgattcaataagcagaagccaataaaataaattgcttgaaagctcagaacgattccaaaattactcgttctgggctttttaggtgtaagcagcgaccaatcaatcgaactttctggacgctacgtcgtgtgaacgatggattcccctggcacattccgtatctactccgttataagttgcctaagtttattgttctcgaattcgccaaatatgagctgtacagacaagataattggcaaacatattaagaaattccgatggtttagtaaaaaaacgtgaaaaaattagcttatttccgaacgtttgtgttatcattttgcatagactttaaaaatgatgatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacgattttgaagaaagtgtttcaggcccggggaacaggaatcttggaaaccattcccggtgctgctggtggtgcacggtttattccttatattttaaaggaagaggcccaagaatttattgacgagatgaccaccaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaacgtgccgtttgtgattgtccgcaatgattctaaaattacggaaggctcgaccgttagtgtgaactatgtctcgggttcttcagaacggatcaagaagatggaactttctaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgagtaaccaacgtaagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatcgatggtcgaccacgtcttgacccaagttgaagccacccacatggcaaatatcgtgaccattgtaggccacggtgccaaagatgtggaagcagcattaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaattatttgaatatcatcaagctaagggtgccgctggcacgattttaacgtccaaggcacctaatcctcaaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatggggataaatacccgtgcagctctagcccaagcaaccaaagtgatgcaacaacggatcaacgcgcagcatatggaaaatggggtttcaattatcaaccctgacgatacctatattgatgcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgctgacagcaatattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggtgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggccgcttaccacacgaaccagaaaacatgtaattattatcattgataattgaattcagagaccatccaagtgcgttgttgctgggatggtctctttttgttagctcatcggcgtgacttgtggtgtaataagggctatttagctgctaaataggacaaagttgatttgactgtgtcagttcagggcaactgagtgattttaattaagtcacgaaattggtataattggcgaggagtttacgggacggggaagtttggaggcatttagatgcagacgaagaagtggattcgcggccttgtttgtggtctggcattgcttggcggttggagctgggcattaccagtacacgcaactagcgttaaaagtgagcaaacagccgttaaaaaaatcgcgcaacgggatttgaaatcgctaggtgggcgctggtcggtcaaggtgacccgattagatcgacgaaaactaaccgtgcaaacgggaaatcagcgcatgactcgtcaacgttctgctagtacgatcaaagtttatgtgatgctgacgatttatcgacgggtccaacaacgaaagttacggctaacacagcaagatcaaaatgatttgaaattaatgattcataattccgataatagcgcggctaaccggttaatcaaacgtgcggggggcttcaggggcgttaatgcggccattaagcattatcgattcaagcagacggttttacaacggtatatgcttgatacgaatgcgctacgctggggacgcgataattacacgtcggtggctgatctaactcgttttttaacgctgacatatcaacataagttattaggtaagacgtatgataagaagatgctgaccttacttaagggctgtcgcaaccacagcaagctaccatacttagttaaacacgtcacggtctataataaaactggtgaatatcccgataagggtgtccaaaacgacgcggccatttttaagaccaaacaaggcacttatagcattgtcgtcatggcccagaatggcaagcagtaccaacaatatcaagggatgaatcgcttggggcgcgatgtcgtgacttatttaaatcagcaccactgcgtgtgtttagataactgaacagtctagtagattcctgttcgtcagccggtgtgcgctctattccgacttctagtactggctacttttgaacgcgagaaacggcagcggtcaagtaccaactaagacaataactagtgcaatgcgtgtgtcagtaccaattacaactgatagcggtctcattaactaagattgttcggtaatcggggctcacgaaactttaatctttaatcacgaaggggcttagattgccgaaagtcgtgcttccagcccagtctcacgcaattttgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttgggtaagacttcggtcgatcgctttagtgatggcgaaattcgcattaacattgaggaaagtattcgtggtgatcaagtttatatcattcaatcaacttccgctcccgttaatgacaatttgatggaactattgatcatgattgacgccctacgtcgcgcgagtgctaagaccattaacgtggttattccttattacggatatgcgcgtcaagatcggaaagcacgttctcgcgaaccaattaccgctaagttagttgcaaacatgctggaaacagccggtgcaacacggattttggcactcgatcttcatgctgcccaaattcaaggcttcttcgatattccgttggatcacttgatgggtgcgccactgttagctgactacttcctgaaccaccacttggatgaaaatgctgtggttgtttcacctgaccatggtggtgtgactcgggcacgtaaattagctgaattcttgaaggcaccaatcgcgattattgataagcgtcgaccacgggccaacgttgccgaagttatgaatattatcggtgatgtcaagggtaagcgggccatcatgatcgatgatatgatcgatacggctgggacgattactttaggtgcacaggcactggttgatgcgggcgcaactgaagtttacgccagttgtacgcatccagttctgtctggtcctgccatcgaacggattgaaaagtcaccaattaagaaattagttgtgacggattcaattgaattaccagctgctaagcgaatcgataagatcgaacaagtttcagttggtcaattaatgggtcaagcaatcaagtttatccatgaaaataaaccagttagtccattatttaagaatcgtttccataacgaagaaaattaattgacgaagcgtcaaattggcaattgctgatttgacgctttttaagttgcagtaatttctaaaagtgatagagtaaaggtgttgtttggtgggcattgtgacctagtcaaagttggactggacgccgtatatcaacgaatctttcgttttggcgtgcttcaacattaattaggtgatggcgcggaacggataacggaccaacgtcgggctaccggcgtcctttttttatccataaacactagcacgaatccttaaaatgattacaatataagttaagggggtgttgcgatgacaccgttttattggggtagtttggcccttgctagtgcgttgaccttgcaattgacggaccggcggcattggttaacgggacatctttttttgattgcagtcattggcattttgttaagcgcttaccatcgattcagtgcgcaggcaagtcctacttggcaattcatgttggtcggtgcaaaaatcttggcttatacgttgttgccaattgtaattttgattgtgggcattagttttgtcaggtatagttaccgattgattcgcaaggagggctgggcgtttcattacagcttgctagcaatcgtcggtggcgtattagtcataatgttgatcctatcagtcatcaacttaggcgtttggcactcacggcgcttatggcagttcttaggcctggcgttattattgacggcgtattttgcgttcagctttttcgcctacctattagcttgcgtcacgaccaggttgggtcggcaccgacaaatcgattacatgatcgtcttaggcgcgggattgatgccgaacggccagccaacgcgaacactagcatatcggcttcaggcggcagcgaagtactaccgggcgcagcgggcgcgttatcatcagccaatcacgatcgttgtttcgggtggtcaggggcctgatgaagtcatggctgagagtaccgcaatgcggcagtacttggttgatcagggggttcccagagacgccattcaagaagaaaatcagtcaacgtcgacgattgagaatctaaaattttcgcacgcactaattgtgcggcagcaaccgttttatcgcgccgtgattgtcacgagcggctatcacgttttacgggctaatatttttgctcggcagctgcacctgaacttaacgggaatcggggcgcacaccccactgtattatttgccatttgctatgtttcgggaatacttggccttaattgtgatgtatcggtgggccaacttagtggcggtacttggtttaacggcttattacgtggcggcgttagttaggttaatttagtataatcgcgtctcggagctttgaaaaaactgacattgcgattaatggtataatggagaatgataaaaaggaggggtttgccgtggatcatgcctatcgatcatcttggccactgtttgtaatcgtcctgattggattgattacactttcaggctgtgccaaaaataccggaggcgtaaccgcaagttcggcaacgaccgcaactggtaacagtacaacggccgttttaaccaaagctgatcagcaaatttcgcaacaaaaaattgccgctgcccagaagactttagcgggtgcttctgaatcaactccagcgatcaaaaagttagcccttgggttaaagtattatcaggaagctgaagaagcacttgataataatcagctcagtctagcaaagggttattttgacacgttaagtagttatgatggcacgactgacgccagttttattgctgctcggcaaaagctcgtcaagcagtaccaggcggtcaagctagccaatggttactataacgctgcccgtgatgaattaagtattcatgatttggccactgcgaaggccaatattgataagttggacgatgtgcaagccacacatccggttatcaaaaaattacagaaaaaagctttggcaatgaaacaagccattatgaattatgaggcgtcgcaatcaactagttctggtagtgatagctcaacggttgtcagttcgagttctgcggctagtgcgagtgatagtaggacgtcttcaagcagtacgagtagtactagtgccgatagttcaacgatgacaagttcgtcgaatagcagcacgtctgccagcagtagttcttcagagctgacaacttcggcgatcatcaaacagtttcaggatgcgtccggtgttacgtttacttcggataccgaatttaatattactaaggagaccagtgcttattatcagattaccgcaatctatgcgacgaatgagtctagttcttctgcttccaagacagtaacggatacttatcgttattatccggatagtggtagtgttactaaggaaaatagtgcaactggtagtttcgaataaccagcattaaaaagtgacgatcaggtaatgactgatcgtcacttttttgcttgactggattgtttagaaaacgctgggtagcggtcataacagtgataaaaaagcaacgctcacggcacgttaaaaacgagccattagcgttgcttgaattagtttgaaaaatagtagcttaggcgagtgcccaagtgttaatggcgtgtgcgaccccgtcttcaacgttagtcttggtttcataacgggcaatttgcttggcctcatcaatggcgttacccatcgcaacactgttggttgcgtaacgcagcatactcaaatcgttaccttgatcaccaatcgccatgacttcatcagcagttaagttcagatggtcggtcaacgtggctagggcgttacccttgctagcggcgggattcatgaattctaggaaatacgcttctgagcgaacaatggtaaagcgcttggagaatgacgctggtaattgcttgatggctgcatccagtagtgggccgtgatcgatgaacatgcacttgacgattggtaagtctgggcacatttcttccggtgtccggaaccgaatcggcatattgacgagtgcactttcgccgaccgtataagggctgatatttcgattggcggtgtagatatggtcttcactttcaacgtgacaatggatattgagttttcggctgagcgtttcaatgtcgatataatcgtcatgtgacagagtaagtcctgtgatgatcttgccagtaattgtctgaaccattgagccattaaaagtaatgacgtaattatcttcaccagcgattccaagttgctttaaaaagggcgtgacgccacttaatggccgtcccgtacaaatgacgactttgattccttgcgcgttagcggcgttaatcgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctggaattcttggtaaattggtttaaataaatcgttttcggcgtttttgctgagcatttcttttggaaagaaaaaccgctgatcgccagagactttcccggtgatggctcgcactaggtcactgacggtggatagttctagtaaggaaccgtctttttgttgcagttcaatctgggtacgcggcttcttcatcttaggatcataggcgtcgtaagggagatcgtaactgtcgttgatgtcagtgtagtagtgcgtatcaaagccggcttgttcaattaatttttgtaacgttggaattagcggttgagtcgttgcatcgactcgtgctgattttaagggacgtcggtctaagaaacgggttgctaggtcagcgagaatttgatcacggctatcacgccaatggctaaaataagtgtttaagacgccatcgtctaaccgtaaataatcgtgtaacgtaaagttattattgaaaaacggcaataacatcactggtgtggcttcagcgtcgaccgcgtggctttgataaagatcgttagcccgctccagtaggcgatctaggatgacttccatggaacgtgatactggatggaaatagacttgcatgtacatctggaagcgactgacaatgtaatcttcgaccgcgtgcatgccttccatcgcaaatgtaatgccgccttgatacggcttcataacgcgcaaaatacgggtcaaatcaaaattgccgtaattcgtacccgtgaagtacgaatctcgcagtaggtagtccatccgatcggcatcgatttgactagaaatcatctggacgacttggggattcgggtacgttttttgaatgacggccgcaacttgggccgggaagtcaggtgagacttgctgtaagacctgattgacctcggtttcaggtgatgtcaaaatctgaacagtcagggcttcatggtcggtgtgaaagatgtgctcgaatgtgtgcgagtatggcccgtgaccgatatcgtgtaacagggcggcgcatagtgcgaccaatcgctcgtgatcatcccaaccaccgtcaccaggggcctgggtcgggtagttacgttcgaagttatcgcaaatacggcgtgtaatctcataaacaccgaggcaatgtccaaagcgggagtgttctgcaccgtggaaggtcagcgaggtcgtaccgagttgcttaatacggcgcagtcgttgaaattccgaggtgttgatcaaatcgagaatgacttgatgttggatataaatgtaatcatggaccgggtcacgaaagactttctccatgggtaatagttgctggcgatagaccaaattaattccttctttcagtgatgcaagcgttgttgtcggcgttgcatttgttgataggcttgatttaagtgtgcttgaaattcaggttcttcggtgactaacggcaaacttgttgtgtcgaccgtcccatgttgagctaggatggctataaaacgagcttgtgtagcggtagtgtcagtcggcgctgccaaagcgtcagcaacggtcgtcatgacttgtggatcaacatctggaaaccgcgcgtcatggtgaccggctaagctgacttggtaaaaacgctgaatgagttgactacgggccatctgatcgccatcaacgctgacatacagcatgatgaccagcgcttcggcagtgcgccgttgcgacattccagcaattttacgaccggcaatactcaaatcataatcaccaggacaataggagcgtgtaatctcaccagtcgtgatatttaattgtggccaaactgcctgaacgtagtcgaccatcaattgatatgccgctgtaattgaatagcgttcacgagttgctggaagaaataaggagacgtttagtacaccagggtcagcaactacggctagcccacctgaattacggagcatgacctgataaccggcagcgtgtagatgtgctaagccagcagttagccgtggcaagcgttggtctaataggccgagaatgacggttggctgtaactgccagaaatgaacgattggttgctgacgagccgccgttaaccacagcagggcgttcgtgtacgcaaaactatccagcatcgctgccggttcgtatttttgactcaaagttgcaattgttgattccgtcaagaaagccaccccgtcatccgttgttatcgggcacgagggatgtctcatgatgaaaccgccaccgttgtccgtatcatcactaattatactagaaaaatggtaccgttgcattggcttagacaaatcaacttaatctgtagcataccatcataggataatgaaacgtgcaagttagttggctttttgttcgtcagcaacgtgcggcctattttgacctccggggctgagggacaattgttggaacacagccgactcaaaaagtttacgcgggttcgaacttttcccagcagatctaagctgaccgcttttagtcctatttttagttattttggcatgaatggcttataattaaacaggaagttttacgatgggcgtgatgggagtcgcgcggtcgtgaacgctgaaaaggatatagcgagtgtggtaacacggtgattgtagacgggcgttcagcgtgtgattttgaaatattaggaggtccaaatatggatgatttaacaactggtgtgccagtggcgattcatttagagacgcaggcacggcaagatgacgatacggcgaactatgcactggatgtcgatggtcaattggttcagatgggtgacgcgttttatttacggtataaggaagttaacgatgatgcgccagaaccgattccagtgacgattaagctggcagctaatggggacgtcgtgttgacgcggagtgcggagaaccgacttcggttgcacttttccaatggtaaacgggtgcgtgctcattatcaaacgcctatggggatgctacctgttgaaacggtgacgccgatgttacgagtacggctacgtgaacggccattttcaggtgaggtgaacgttgattacgatttatacgcgggtgagcagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaagggaatctccttgtattatcttatttgggctctctggtagaaatacctgagacaaacgatcgtattagctccctatttctgttgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagtcttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacggtgcaagtgattccgcatatcacgaacgctatcaaggaaaaaatcatgcgtgcgggtacgacgacggattccgatatcgtgattactgaaatcggtgggacggtcggtgatatcgaatccttgccatttattgaagcgctacggcaaatgaagagtgatttaggttccgacaatgttttctatatccataccacattgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgttcagaacttatcacggaccatcaagattgcgctagtcggaaaatacgtcgctttacaggatgcttatatctcagtgacggaagcattgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggcaatcaagtatgcccgtgaaaacgacgtgccattcttaggtatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagttgaagccgggaactgtggcggctaaagcttatcacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaatatcatccagaattcttatcacggcctaaccgtccagaagggttattcaaggcattcatcgatgccgctaaccagactggtaaagtgaaggcataaatttagtacggtagaattaagaataaagcacgccagcgaattgttggtgtgctttttttgttgggcggccacgggcttgattaggtcaccgatattcacagtgacaactggtgttgcgaaaatacatggtaacaataaatggttctcttgataatagaaaaataaaatgataataaaaaactattgacaataaatggcgggaggtctagattataagtttaaattgaaagcgcaaacataatgggttagtagttaatctggttatttagaaagccaacggttgctgaaagttggttgattggactgatgaatccgccatttagcgtttgacttcatttttaagaggtcgcggtgagacgatatacgcgtagagcagtaaattgggtggtaccacgttgataaaaaacgtcccatagtcttttaggtgaagactatgggacgttttaattttaaggaggcttttcgtatgttaaatccaaagtttgttcgtaataacccagaacttgttaagactaagctccagactcggaaggttgatccggctgaggttgatgaatacttacagttagaccaacaaaaccgggatgcaattaccaaggttgaaggattgaagaaacagaaaaaccagttgacggaacaaattgggcaaagtgatccgcaatcggaagcgggccaagccctcattcaacaagtcaaacagctgaatggtgatattaagagtacggaagcggcccaaacggaagtaaacgatcggcttcattacttagcgattcgcttcccgaatttacctgccgatgatgtaccagtcggtcctgacgaagatagcaatgttgagatgcgtaagcacggcgatattccaacgtttgattttaaacctaaggcgcactgggaattgggcgaaagcttaggaatcttggattttgaccgggcagcaaaagtcgcgggcgcgcgctttgtttattataaggatgcgggtgcactcttagaacgggcggtttacagctttatgctagatctgcacacacaaaagcaagggtaccatgaaattattccgccatacttggtgaacgctcagacaatgtatggaactgggcaatttccgaagttcaaagaagacgtctacacggttgaatcttcaggaatgacgttgatcccgacggctgaagtaccgctgaccaattactatgcgaatgaaatcttatctgaagatcaattgccaacgtacttcacggcgatgacgccttgttatcgctccgaagctgggagtgcggggcgtgatacccggggcttgattcatatgcaccaatttcacaaagtcgagatggtcaagtactgtaaacctgagaattcatacgatgagctcgaaaaattaacggataatgccgaagaagtgttgcgcgaattagggcttgcataccatgttattaagctttcaacgggggatactggtttctcatcagccaagacctatgatgtggaagtatggatgccagaacaaggcgtttatcgggaaatcagttcatgctctaactgcttggacttccaagcacggcgggcgatgattcgttaccggaaagctgatgggacggtcgattacgtccacacgttgaatggttctggacttgctgttggccggacggtagctgcgattttggaaaattatcaacaagccgatggcacggttaagattcctaaggtgctccaaccttacatgcatggtatgatagagataaaataaaattattatgagaataaactattattcaaataattcatttgaatgttaaacttaatatcactaggattgagatggatacaggctaggactgttatgataatctcagtcctttttaatttggcgttaaaaatgcttaatttttataatcgaaatcacatgaacggtaattgtcaccgtgataatattttatcatgaagaaaaggttttcacggcactaaagtgatgtttatcacaaagtggcgttttacaacgagtcgagacgttaaatctaatgggagggttattcatgcaggttatgttagcacattctctggtgtgaccagaacaacgttataaaaaggagatttaaaaatgacaaatatatttaagggttggagaaaaaatgatactttttggatgctgagtttgttcggaacggcgattggggccggcgtgctattcttaccgattggagttggcacggcaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtacttgttgggattctcattggaattgctcgctttggtacctctttgattaccaaagttatgagtggcctggcctttccatttattattgtaatcgttctgttttccttttatcttattccgcattggaacggcgcaatcctctcaacattttccagttctgtatctgggggacatttggttggcactttaggaaacttgtggttacttattcctgttatgatcttttcgtttaaccattctccgatcatctcttcattttccgttgccgaacgtaaagaatatagtggggaaggtaaggacaaagtcgataaaaagatttcgacaattctattgtcggccgaaacgttgatggtcattgtcgcaatgttctttgttattagttgtacattggcgttgactccagaccaaatccttgaagctaaaaatgaaaatgtttcaatccttgattacgttgcgactgctttcaataatccaattattaaatatgtttctcccgtaattgcttttattgcaatcgccaagtcctttttaggacattatctaggaacgagtgaaggcttacgtgggattattcgtaagatggaagaaaaatctaacaagacgctttcaagtcgaactgtttcaacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttagtaatctgactaaaatacgagatgaattcacattggttaatattattgaagccaatttttgtcataaatctcgttgctagtgttattgacgagattcgcatgacggtgttggggttcgtgagggtcgcgaatcgaatgaccatactggaggctggattaatcacaacggcggaattaattcagaaatgaaagctttgatgcaacggctttatgttttctgatcagtacaactgtggtgcttgcttgtgccgtaacttcaagattcataaagtttcgaaacgatgtactgacgatgaatgcgcaaagaagcgctagttgcccgtaccaaagcttaatttaacgtgatgattcaaataggaggatgactaaaatgacggtgaattacaagagtgtttttgatattattggcccgattatgattggaccttccagttcccatactgcgggggcgtgtgcgattggtcgagcagcgaatagcatttttcaggagaaaccgacagatattgtcattcattactatgaatcatttgcgcaaacccacaagggccacggaacggactatgcgattatcagtggcattcttggttttgatcctgatgatagccgggttccatatgccattggtttggcccgagatcaggggataaatattacctttatcgaagagcctggtgatagcccaatcaaccacccgaacactgccatcattgacttaaaaaatgatgataagcaagtgacggtcgctggatgttcaatcgggggtggaaccatcgaaattcgtgaaatcaagatggatggttttgatgttaaacccaaagggccacttcctatcttgttagttcaaggtggtgagaatgaccatcagcacgtaaccaaacagttggctgatctgactaaagtaaacgaccagcagcagtacaagacggctcggggcaatttatatgaatatgatttggatcgccgcctcaaacaggatgaaatcaaaaaattagcgcagggacacgcaaatttagtttacttataatcagggaggtcagttatgatgtacatgagcgtagcagaactggtaacagcggccaaggagaccaagaagccgatctacgaattaatgattgaacaagagatggaaacatcgcaaacgagtcgtgaagaaatctggcacacgatgggccggaatctagacgtcatggaagcagctgttaataaaggggctgcaggcgacggggtctattcaacaactggtttaactggtggtgaagctgttctcttgaaaaagtatcgtcaaaaagggcacactttatccggcgatacgatgatgcaagctgttcagaacgcaatctcaaccaatgaagttaatgcttcgatgggggtcgtttgtgcgacaccaacggctggatcgacggggacactacctggtgtgattttcacgctgaaggaccgaatgaacctcaaccgtgaccagatgatccaatttctatttaccgctggcgcttttgggatggtcatagctaataatgctgggattgctggtgcgactggcggttgccaagctgaagttggtagcgcttctgcgatgggcgctgcggccgcggttgaagttgctggtgggacgcctgaacaaagtgctgaggctttggcgatggcaatcagtaacttgatgggattagtgtgtgatcccgttgctgggttagttgaactaccgtgtgttaaacggaatgcgattggggtcggtaatgcgttgattgcggctgacatggctttggctggctgcacgaacaagattccagcggatgaagtcattgcagcgatggataaagtcggtaagggcttgccaaaggcacttcgggaaactggactgggtggcttagcggcgacgccaaccggtattcggatgaaggaaaagatttttggacgatcgactaattcacaagttcatgcataaaaatgtcgcagaaagatgatgagctgactaaaggcggtatcatcttttttaattagatgtttatatcgttacatgtattaacattttatcagtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcgacaagttggcgatcctgcaactgacttagcgttgcgaacgatgaaggccggtaaagctgaaaagcgtgattatctagccaactacaagggtgtttcgcaaggaaagcactcactacgatcgtcaacttattttttgcgattagatggtgaaatcgtcgggatgatttgtattaatacggatgatagtgccctagacgatctgcaggaacaagtattgaaggtaatggcgagttacaaacatttgaactcaccaacgattaatcaactcaaaggaacaccagctaatgagaaggcccatgacacgccggtcgcgccggaacatctaaccacttctatcactgatttagctcgggaagtgacccaggctgtctgtgctaagtatggcgtctctgttgaatatttaaagcaaaatgaaaaattagaaatcgttcgtagcttataccaccaaggttacttcctattgaaggattcagttagtgaagccgccaaagtgctcaaagtctctgatccgagtgtttatcgttatttgcagaccgtcaaagatgaggatctccagcaggattaaacgatgtaattgtaagcgattaacgtcatgaaaccctgtcaaaatttagttcagccatagtggcgaaactgtgaggaagctactctgagttcccggacaggtaagaatcatggtcaccaccgtaaaaatgcggcagccaacacaacaagtttgtgtaagggctgccgcattttaagttttaaactgagcaatcaaatatcccgttgttcagtgatggccggtcgcaattattgtggatgttagtgccaggttagcgtgtgtttttatgggattcgggttggaacgcagccgatttttatgataatttgtttagaatgatattattgaggatgacagcggggattttctatgtcttatcaaaacgggggtattaatgattttattaatttagttatcaactgattatcatcatgataaatctcatgcaattctcattagctgacatcaagctaaaaggctgatgtagcagggggtaattgctattattatcaattatcaaagattatcaaatcgtatcatagaccgttgatcattatattatatggtattatggtgaataataaatggaggtgatgccaatgttgacaccaaacgaaattcgacgtcggttacgacgcgatttggttactattgccgaagcttatcaaattggttttgagagccgtctatacacagaagctgagtatgaaaacttaaagcagacgttattgcagttgcgtgaacttaatatgaacccccaacatatggaacagctacttgcgattaacgggtaacggaatgttgctaaattaaataaggaagtgattagtcatgaatgctgatagtccatcaggttcaattcagtccagagagtgctaatgccagtgaaatttatcacgcgcattagcactcttctatttttctagcgggcggtgtgttaataatcatttaggacttgagtaggattaaaataggtcgcttagttgaattattattcggtatcacgtcgctcccaatcatcgtatggagtacatagtatgacagtagtaaaatcggtggccaatcgtggcgttaattacgtgacaatgttaactgttgatgtcagaatgaattgtacagcatcgcacgtcttggtggcaccttaaattacgcagatttagcttaattatcttacaaaatcgttcatgaaagcgtttgaattagtcgagttaatgattttattgcgtaaaaagattacagtttcctgatattggttgtatttttgacggacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaatgatgttctaacaattgatccaacaaatattgaagaatctgaattaccaagtcatgccattaaaagcttgcgagcttcttactactttatgggggccttactcggtcgttttaaccgtgcaacggtgactttccctggtggtgataatattggtccacgaccaattgatcagcatatcaagggttttaaggcgctcggcgctaacgtcgttgaagagaatgactctgtctttatctcaacgggcacagagggccttcacggagcgcgcatctttttagacgtggtttccgttggggcgacgatcaacattattttggctgccgtcaaagctcatggtacgaccacgattgaaaatgcggctaaagagcctgaaatcattgatttagcgacttttttgaataatatgggcgctaaaattcggggtgctggtaccgacgtaattcgaatcgaaggcgttccggcactgcattcgcgggcaacccatacgattattcctgatcggattgagacgggaacgtatctatccctggctgcttcgattggggacggtattttgctaaagaatgtgatccctgaacatatggagtcattcacggcaaaactagtcgaaatgggtgtcgatttacagattaatgaagatagtatttacgtcccacggtccaatgatttggacccaattcgggttaaaacaatgacttacccaggctttgccactgatttgcaacaaccaatcaccccattattattgcgtgctaacggtagtagcgtggtgattgatacgatttatccgcaacgcacgcaacacgttgaacagttacgtaagatgggggcggacattcgcgttcaagataacttgattgtcgtgggtcattcttcccacttacaaggtgcacatgtcgaggccggtgagattcggtctggggcggcactaatgattgctggtctcgcggctagtggcgttacggaaattagtcgcgctgacaatattctacgtggctatgatcgggtcatcgataaattgcatacacttggtgcggatgtggaaattgcagccgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataaaaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacggttaacggtaaggatcctaatgaggccaagcaacggccccattttccagcgttaacaccactttatccacaaaaacaaattaagttatcgacaacggccgccgttttagcgacccgtttgattgatacttttgtcccgattggcttcggtcaacggggcttaattgtcgcacctcctaaagccggtaagacgacgcttttaaagaatattgcaaatggcatcgtcgccaattatccagacgctaagctgattatgttactgattgatgaacggcccgaagaagtgactgatttagagcggtcaatcaagggagaagtggtgagttcgacttttgatcaacaaccacaaaatcacgtgcgtgttgcggaattggtgcttgaacgtgcgcggcgcctagttgaagacaaacaggatgtgattatcttattggattcgattacccggcttacgcgggcatataatttggttatcccgtctagcgggcggacgttgtctggtggggtcgatcccacggcgttttacaagcccaagcgattcttcggttccgcgcgcaatatcgaggaaggtggtagcctaacgattttaggcaccgcgttagtcgatacgggtagccggatggacgacatgatttatgaagaattcaaaggaactggcaactcagaattacagctatcccgcgagttagctgaacggcgggtcttcccggcgctagacttgaagcaatccagtacgcgtaaagaggaattgttggttagtcgtaagaatttggagccagtctggcagattcggcgatcaatgactggcaacgcgttagagtacaccgaacagcttttacaatttttaaaacacacgaagaccaacactgagtttgttcgtgatctagctagcttaaagttcactggtcaagcaacccggcggtcgcgtcgttaatactggcaggcaggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagtttatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggctggggcgtcttttttggggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgccggttcttgataaagcttttaatattggtcattagctgaggactgatattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcacaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagcttcgcaagcacttgtaagcttccgttagtagcttcttgaacaactaaatcagtaatatttgggtctttaatttggagcagtactttagtagaatggtcttgggacatatctgacactcgctttcaattggttttggtcgacttgattgtagcacaggacgatatgtccttttgttgtacataaaaatagtgttgatggattttatccatcaacactaaatatcatagaccccttttttgtatgtgcaaatcatcgacactcacaaacaaagccgcaccagttcgagtaatgaactgatgcggctttgtctcacttacgatatgattagtagcgcataatcgcgagagcagcggtttctacgggcatccggtctgcggggatgattcggatttgcccgttcatggcaatcacgacatcgaccaggtcgtcaattaaattatcaggagcagcaattggatcatttaattgaacatcggccgctggtaaggagccggcaacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagtttttcggtgacttattgatcatgaggtgttgtgacaagtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggccttcgcattatgaccatgatagttggcaccgtgaacggggctggcgttgaaattcaggtcaccgccacgtttttcagtgcccaatgcttctgtcagggtgcggggggcctcagctggcaaatcaagttcgacgaaactgccatcacgttgggcgtagagcgccatgctatcttcattgagtgctagcaagtcgaagtcgaattgatgctggcggtcggctagtactgggcgaatagctggcatgctattgacgctgacatggttgtcagtgggatattgtaagtcgaaaatgtgtaggtcacgactgttagtgatgatgcccgtctgagggccagtgtgctgtaaccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatctgattacggacgcaaatataatgattatgataagctagagataattctaacgaactaaacgaattcggggctttattatgcgaactaattaaggtatatttaccgtagaacctttgataaagggcgtaaacaaattaggaggcgggattaatgaagtccaagcaacatcccgggttaaagtggttaggtcggggcgtttttgtcctgctggtgctagtatcattggcattaattttcaatgaacagatcaagagctggttagtgagttcatactcgccgaccgttacggctaagacggttaagcagaatacgaagaagaagagcgattttaacttctcaaaggtcaagtcacttgactttcagaccgttgccaaggcccgcatgaataagaatgcaatcaacgtgattggctcgattgcgattccgtccgttgatttgtacctgccaatcggtaatggtgtcagcaatgaaacgttagcattggcggctggcacgatgaaagctaatcagaagatggggcagggtaactacgcgttggctggtcaccatatgatcaagcatggcgcactattcagtccgttgtactataagagcaaggttggccaaatgatttatgtgagcgatgccaaaaagatttatgcgtataagacgagtcagcgaacattcattaaagcaactgatgtccaagtaattgatgatgttcctggtcagaagctgattaccctaattacctgtgataagaccggggcgggtcgcttaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcgtggagccaaatcgatgttcagctaaaacggcggactgatttgattcctaatctggtcaatacggtcaaaggttacgcgaaacatgaaaagagtaccttagcggaagtgatttcattacggaatcaattaacgcaagtgccgagcggtgatcaccaacaggctatggcagtttctgatcaattgacaaattcgttgaagagcatttttgcgttagctgaaagctaccctgatttgaaggctaatcaagaattcggtaagctgatggaagagttgaccaatacagaaaacaagattgcttattcacggcaactgttcaactctagcgctgccagctataacatgaagttacaacaattcccgtcaaatattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttttttaatagtgcgattgcagggttactagtagccttgattgcagcggtattttatatggtattaatgattagtcagtcgactgacattgtcatgagcatgaatcatggacgtgagctgcatcaagctgacgatgatccagagctctggcacattgtggaagacatggcgttggttgctaaagtaccgatgccacgtgtctttattattgatgatgagagccccaatgcgtttgcgacaggaaatgaccctgagcatgcggcagttgcagtgacaactggtattcaggcacgattaacgcgtgaagagatggaaggcgtcattggtcacgagatgagtcatgtgcgtaactatgatattcggttacagaccattgccttggctctgacagcggccatcagtttgttagtcaattggggtatgaacgccttttggtggggcggtggccggcgcagtcgggataatgatcgtgacggcaacggtgcccaggtcttactaatgatcctagcgattgttgtcattattttagcgccgctagcagctagtttagtgcagatggcgctatctcgtaatcgcgaatacttagcggattccggcagtgtggaactgactcgtaatccgttgggcctaatcagtgcccttgaaaaaatcgatgacagccaacccatgcaagcggcggatcctagtagcgcggccctctatatttctgatccgtttaaggcgaagaaatcatggacgcacttattcgatacccacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaaacgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcggcacactttggcagcttaccgtggccggcgtatgtttatgcgttcactgagtgttccacgagtacctgaagcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacctgtcattatggttgctgatacattgacggcactacagcagctggggcaatactatttacaaaaaattaatccgaaagtcgtggctgttacgggtagtaatggtaaaacaacgacgaaggatatgattgcgagtgttttgagcactcagtttaacgtgacaaagacgcacgccaactttaacaatcagattggtgtgccagtgacgttactcagtatggaaccgaatacagaagtggtcgtcgttgaaatggggatggaccattttggcgagttggatttcttgagccgtctcgttcaaccagacgttgcggtgattaccatgattggggaagcccacattgagttctttggtacacgggatcgaattgctgatgccaaaatggaaattgtccacggcttaaaagaagatggcacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcggcactcttggtagctgatacttttcacattcgaccagccgctgcgcaacaagcaatcgccagttttgtgccgacggagaaccggacggaatggttaactggttaccgtggagaagccatcttaagtgatgtttataactctaatccaacggcagctcgacgggtcctagccgcttttgcggcggtacctactaagggtcagcgaatcgctgtactcggtgatatgcttgagttaggtgaacagtcagatgcactacacatgagtttagccagtgaattggatccagccacgattgccagcgtctatttgaatggtgaacatatgcgagcgttggcagaagtgctacaagaaaagtacccagccggtgcggtccactattatcaaacggatcaacagcctcaattgattgccgacttaacggcaacggttagtgcggatgatcaggtcttattgaaggggagtcacgggattcaccttgaaaaggttctgacggcgctggaagctgctcctgaaaaataaaatttaagtgattcgattaagcaggcccctcgcaatgactgggtaatggtgacgctaacattagactgataatgttatttcccttccggtattgctaggggctttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgacaaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcctggccggttgcttgaccacattcgccggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgacccggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattctggttgcaaccgatgtggctgctcggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaattagctgctgcagaagcgaatgttgattcgttagttgctaagacttcgactgaaaagtatgctgatcaagctgctgaattattacaaaaatacgatgctactgatctagttgctgccttgttaaatgacttaaccaaggacgacgcctcagccgtacccgttaagattacgccagaacgcccattatctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggtgatcggaagagcaatggttataaaggtcgcagtcgcgatgataaccggagcagcaaccgcaaccatgatgaaggtcgcaagcaaagcagcaagcggagctatacgatccgcaccaatgattaaagtcaacgcacaaattaagttgaattaaattaactttgcaaaaaagccgagcgcacgctcggctttttttatgcgacgaatttacaattgaagtgcaacaagtaagaaaaaaataaaaaagaactcatagcctgagtcctataaaatgaagtcaccacaacaatcatctaaaggagatcctaggctatgagtccgtacaaccatcttaccttaaaagaccgagaatgcatactgttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcgtggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctggtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcgccctacaatgttagaatacaagtagtcggcagatgttcgtatgaattattgttaaaacgttccaatttaattggtttgttgttcgtcagcacttgcacgtcttattccgacctccggggctgggcgccaattgctggaacgcagccgacgtcgatttgagctaacgcccaacccgcgtcatctcaaatacgagtcttattctaagccggaagcaacccacttccgcctaagaataacttggctactgagcattgtcacccagcccctccagtctcaagcctgtgagaggccacgggttgaagccgagcattgcctagccaacggattaatgcggttttggcattagtccgttggcgtagcaagcacaggctttaggggtaccgaacacgtttcgggaacccgctcgaatggcagatgaacggccacttaacttggtacaattggtcgctgactattttgacaccggaaccttaaacgaaacgttagggttacattaaccaccttgttgagacgttcgattattatagtgattcgggaatagtgagttatcacaatgtcattttctgtctgacagttgattgacaaaattatggtttatgaaaaacaatgatgaatttactaaaagttgggtacacacatgtccgccactcgaacactgtcccgactggaaggcgtttcggccaatgctcagcggtgaaattccacttagcaagcgtccttggcttggttagtggaagaccagtatttaagacgtggtcttcggcttaaatctgtgtccaccgcgttccagcaattggccgaaatgcctggaggtcggtgttaggacgcgctaacaaagcatgtttacactcactcgacttttttccagcggtctaagctggccgactttgacttgacgcgtttggaacgttttaacaataattcatgctgacatgaaaagattgcgtgtatgggcccttttatcgcggcggtagctgtggtaaattggaaacatcagcctaagttgacgtgataataatgagatagagggggtcacagcgtgatttatggtaccggcattgatttaactgagcttagtcggattgaagcgattctagcgaagggactgagattgcctgaaaagatcttaacaccggctgagttggcggtgttttcacgttacccggttaaacgccagatcgagtttatggcagggcgtttttcagctaaggaagcatatagtaaggcatatggcacgggaattggtgcggcagttggatttcaagatatcgaaattttagacaacgcccagggtaaaccggaagttacgcgccacccgtttgatggtccagcgtggatttcaatttcacacacggatacgttagtaatgacacaagttatattggaaagaggcaatttgtgatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggccgccaaagaagccggggcgaccggcttttgtgttgcaatcctggatgaggccttagcgttgcgggccgctggctttgcggaacccatcctagtacttggaattacggaaccggaatacgccccactggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaagaattggcaacggcggttacgactttgcgtcaaccgcagtcaccatttgactttgaagggatttttacgcattttgcaacggctgaccaggcagatgatacgtattttactcatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacccgcgttgtcgctaacggcacgcttgacgtttgttaaacgcttggctcggggcaaatcggtcagctatggtgccacgtatacggccgcacaggatgaatggattggcacggtgccgattgggtatgcggacggctatgaacgccgattacaaggcttccatgtacttgttgatggtgagttttgcgaaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaagttttatcagacgataggtttgcgaagattgtctcgtacaggctatggttacatggttggttattgagattaagccaataaaatgagtgccagagaaattctggcgctcattttttagagtctcctattttattgatgagggctgttaagtttatttcagtgattcgagtgatttatcggcatctaattataagttcgtttatttttaaacattgatgaaatcatcattgggcagtcttaattaatcggtctgaagtattagttttaacggtgcttagcgattagttctttggattaaattggtaaacggttgctaaaagtgaatggttcatgctattatgagtagcaagatggttatattggggtactatcagatacattgggtatcgaataaagggagatgaggcgatggccgcagctgacattaagcgtggtgacatcttttatgcagatttatcaccagtcgtaggctccgaacaaggaggcatgcgtccagtactaatcgtgcaaaataatgtcggtaaccattacagtcccacagtgattgtcgcggcaatcactgctaaggttcaaaaagcgaagatgccaacacatgttaacatcaacgctgcccatacggggattgaaaaaaattcggttgtgttgttggagcagatacgaacgattgataagcaacggcttaaagatcgcgtcactcatttggatgatcagacgatgcgccgagttgataatgcgttacagattagtattgggttagctgatcgaacacgacgtcggacacaacgcacgtttcaatcatagtcaatcgatggggattaattatttacataattgaactatttcggtgcgatgaccgagtatggataatcagcgggtttcaattcagttaatgactggattgaaacccgcttttagtttctaaattggctaccggtaaatgttacagggcctgttggagcatttagtgatgagctaacgttattgtgcattatgattgtctttctgatgacgattaggtaagctagttgaacccattataacgagggacgattggctgtaactcgtgaatatcggtgaaaggatgggggcataatgagtaaacaggctcagttcaataagcatcgggtggcaggattgttagtcgcgatgggcgttgtatatggtgatattggaaccagtccgttatacgtgatgaaggccatcattaccggtcaaggtgggatgcaggccgttgatgagaagtttatgttgggggccgtctcgctagttttttggacaatgacgttgctcacgaccgttaagtacgttctgattgcgttaaacgcggataatcgtggcgaaggcggtatcttttcattattcgcattggtgcgtcatcgtgctcgctggttagtcattccggccatgattggtggggctgcgttactggcggatggggcgctaactcccgcagtgacagttacgactgccatcgaaggcttacgcgatgtaccagcatacgttcaactgtttggtgccagccaaaatacgattatactgattacacttggaattatcaccctattatttatgctgcaacgttttggaacgaacacgattggcaagttatttggccccatcatgttgggctggttcacgtttttgggagtcagtggcttcgttaatctggtgcaggattggacgatcctacgtgcactggatccctattatgcgtggttactcttgatcagcccggcgaacaaagtgggaattttgattctagggagcgtctttctggcaacgaccggtgctgaggccctatacagtgacctggggcacgtcggcaaaacgaatattcggttgagctggccgtatgtcaaagcttgcctactactcagctatttcggtcaggccgcatggattttaggtcccggccaagcgattcagggccatgtgaatcccttttttgcaatgttacctgctagcctgacgatggcggcagtgatttttgcgacgctcgcggccattatcgcttcacagtcgctgatcagtgggtcgtttacgttagttagtgaagcgattcgactgaaactattcccccgattactgactacttaccccggtaaagcagtgggccaaatgtatttaccggtcgttaactgggggctgtggggcgtgacgagtatgctggtgattttctttcaaactagtgaaagaatggaagctgcatacgggttagccatcacactgacaatgctgatgacgaccactttgatctacgcgtttttacagcaaaagcgcttaccattaatcggtgcgggactactgaccggtttcttcgcgaccatcgaagtaattttcctgattgccagcgcagccaagttctggcacggcggctacgtagcggtcggacttgctttactaattttcctagtgatggctgtgtggtatcgtggcgaacaaattgtcagacaacataaccacccgcttagtttacgacaatatcaggaccagcttgctaagttacgtaacgatcagacggtagacaagttccagacgaacgtggtcttcctaacaagccgaatggatggcgaccaagtggagcgaaaggtattatattcgattttagacaagtggccgaaacgtgccgacgtctactggtttgttaatgtgacaatcacggatgaaccgtataccgcggagtatactgtcgacacgttagcaacggactatttggtaactgttaagttatacctgggctttcgtgtccgccaagatattaaccgctatttacggacgattgtccgcgacttaatggctacgggacgtttagcggcgcaaaagcagacatattcagtcacttctggccgcgatgtcggtgacttccgcttcgttatcatcgaggagaagttagaaaatggtagtcggttatcccgcttggatcgattagtgatcgagacgaaattaatgattaaaaaatacgcgacaacgcctgccaaatggttcggcctagaattctccgaggtgactcttgaaaccgttccaattctattcaatgagatcccggcgttaccgatcactgaaagacagtaatgccatgcagatttctgggggtcagaatcagccagcttagatttgcttgaaaaagttcagcgtagtgtaaacacgctctacgacatctaattgtaaggcgcttcacgtcggctacgttccagcaattggcaactagccccgaaatccggaataggacgaacaagtgctgaaaaatagaaaactaactgtcggcttgcttaacaactcatctaattttaatttttgcttgagcaactgataactcaaaactaatttcaatagctgatactggacgcaaaacgttgatttgacagcgataaaagaacgactgaattcaaatcaaaaattagaaacattaaattttgtgttgacaagtgtgaacttagaactataatctaattatattctaattattcaaatgcggtgatgagataagtaaatcaatcgtgggtttttcagagagccgggtcaggtgcaagccggtattcccgcatggttgaaaatggtcttggagcattcagtgccgaatgattaagcgctgacggtggtccccgataaacggacaaaggtatctcaattcagtgagattgacgtacctgctgaggactattttgcgaaaaatagtcgaattaaaggtggtaacacgagtcatcgtccttctgtcataacgacagtggggcgattttttattatatatttttggggaggcttcgcgtatgcgaaaaaaggaaattatttttgggttattaagttttattgcactgggaacagtattagctggctgcggcagtagcagtgctagtagtaaggatacatctaaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagcgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaagttcaaggaggtagaatagtatgcaaataacagcagtccaattgagtcgaaaaaaagctgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttaggtgggtactttgcttatttattgattgttacgctgattggcgcagttacaaatggtcgaattcgccggtataatggacattttgcccagttgaacgtttcgttagttggcttgctgatcgtgcaggatcttctgaccgaaaagtttgccgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactagaaaggagcttataagatgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggaaaatattagtgtcggcctgaaagtgacgcgtggtcggcattatgaccaccaattggtcgaccattatattgaattgatggggctaaaaggttttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtggtgacgcctcgtcctgggagaatcaaagaaattgtgacaaatccattaccacatccacggtcacggttgagtgtcgattttgctgaatttcggcatcggattcaagataaattaaattttggcgctcatgatggacaggttgctgggtgatgactaaaaaatgcttatcaagatgattggcgagataccagtcttgataagcatttttgctgtgaaaaaacaggatcgcatggtggtgagcttgatatggccatccaggggacttcgttagttggactaagtacgaagaagcaggcttattcgcttaccatcgttgtcgtactggccaatagggtcttaagcgtatcaatcgccgtaatcaatggctgtccatgattcaatgcaacgatagccacgggattatcaggttggtcattaagcgtgaaacccactgctttagtctttgcaggccaatcagttgtgttagcgattgttgtgacggtgaggtggttagccgcgaacagttcctggaccgcgggttgcgccacagtggcaatatcggtgatgagaccatccacggtttgccaagtctctaagtgataactatcagccatggcggcatgccaagcggtcgtgaaagtcgggccgataccaagagtctcaccagttgatttcatctcaggacttaaaacgactggtgattgtggcaatttattgaaagagaagactggggcctttatagcaatttgttgtggagcgggtgtcaagagtccggggactaggccaagggttgctaaactttgaccgagaattagccgggttgccaattgtgccagtggcaagtgagtaaccttgctcatgtaaggaactgttcgacttgcccgcggattaacgtcgattacgtagacatcatcggtggcgacgaactgaatgttcatcataccgacacagtggaggtgttgtgctaatttggtggcaatggtgacgatcttatcttgaacagcagggctgaggtgctgtggtggatagactgtaatggaatcgccagaatgaacgccagcaccttcaatatgttccatgattcctggaatgaagcacgacgttccgtcggagagaacgtcaacttcacactcggttcccgccaagtattggtccatcaagataggcgcaccatggccagctgccaccgctgatttaataactggcgtgagctcatgatcgttatgaacgattgccatggcccggccgccgagtacaaagcttggccgtacgagtaaggggtaaccgattgcgtgagctgcttgacgggcaccggataactcagttacggtcgttccagcggcttgggcaatctttagtagacgtaaacagtccgcaaaagattgccggtcttcggtcaaatcggtagcggacacactggttcctaggacggtgactcctaatttagtgagctgatgggcaaggttgatcgcagtttggcccccaaattgaacgatgacgcccgcgggttgctccaacgcaatgattggcatcaaacgttcgattgttagtggctcgaaataaagcttatccgaggtagaaaagtcggtggagaccgtctcgggattgttattgacgatgattgcatggtagccagcttgttgaatggccttgacacagtgaacggtggtgtagtcgaattcgatgccttgtccgattcgaatggggcctgatccgagtactaaaatactgtgtcctagtgggtgactctcgttagtttgtccaaaagcagtgctgtaaaaatatggtgtaacactggcaaattcaccagcacacgtatcgaccattttataaacgaagggtaaatcagcagtcatggcagcaatggtcgctaccgaagtttgggcataatgcgccatggtcgccagactcacaccgtactttttcgccgataagaggtgttgggacgtcggcacttgcttgatattccggatgagttgggcgatgtgctgtaacttactcaagaaaaatggcgtgatttgcgttagcgtcgctaattttgctaacggccaacccgcttgcagcgccgccaatagatagaagagccgctgatctgtcgggtgggtcaattggtcgatatattcagtcggggtgacgtggtggtcagggatcaaggaagcttggatcttgggatcgatttcaagcgaagcaatcgccttgagcgtggcttcctccaaggttgacccaatcgccatgacctcccccgtggctttcatctgtgttcccaagtgagcgtcggccgttggaaacttgtcaaacgcaaaccgggggattttggcaaccacatagtctaaagctggttcaaaggccgcataggttgtctgcgtgactggattcttgatctcagataaatttagaccaattgcgatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagttgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaggcactcggtgacgggggacatggtcagcccccgctgtaacgtttgggtcaattcgtcggcattattggcaatgccaccacctgaacccccgagtgtaaaggctggacgaacaatgaccggataaccgattttttcagcaaacgacaatgcactggtcacgtggtgaacagtggtacttgctggaatcggttgatggagccgcttcataagtgttttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggtggcccgcagaattttagtgacactggtcaaagtcagaggttctaagtagacttcgtcggcggtggccgtgtcagtcatgatggttgctgggtttgaattgatcaaaatgacatgatagccggccgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggccccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtccgagcaccataggcgagtgcaatcaactgatgaccaaggcaaatgccagccagcggataacgttgtgcgagttggcgaatggtcgctaagtaagtgtgatagtcagtcggatcaccgggaccgttggataacaaaattccgtcagggtgatacgcgtccacggccttgagactagctgtaggtggaaggacaacaacgtccgcgccccgggcttgcaattcagcggtgatagctgctttttcaccaaagttgagaatcgcgacgcgtggacggatggtggtcgtcgctactgggaggggggtagccgttagtacttggggtgcgaatgtggcgagttgcgcttcaaaatcagtgatgggatgattgctcaagattgccatctgggctcccgtttggcgaatgtgaatcgttaggtcacgagtatcgacgccttcaatgccggctacatggtggattgtcagaaaacttgccagtgattggcgactagtatagtgatcattaaaagtggccagctcgtgaacgatgatggcttgtgcgccaatcgttggtgcctgggccacggtcggatcgataccataattaccaattaatgggtaagtgaaggcaatcatttgatttaggtaggatggatcagtcaatgtttcctgataacccgtcattcccgtattgaagacgatgcgccccgcagcctctagctggcaatccccaattgccgttccaatccactgtgtgccgtctgctaaagttaagtatttgttcatcccaatcgcaccctttctgataatttggttaaaatttcattttggttaatgggataagtaaacatcattttattgtggatgtcaattaaaaatacatattaaatgcataaatcactgaataaagctaaaaatatgcaattaatagaataaaaatgaatattttttcaataaagcttgcaatttaaaagcgatgagaatatagtgtgaatcatactttctgcatgaacatgcagctaatacactatttttgaatatttgaggtgattatatgcaagtcgcgctagttggcgttacggggtacagtggcatggtgttgtaccggctcttgaaacaacatcccgagatcgatcgcatccaattatacgggcacgtgggagcaactacggtggcattaaagacggtggcagccatgtaccagaaagaaacggcggttattcgaccattcgatgcgacggcaatcatgcgcgataacgcgattgtgttctttgcgacatcagcgggtatcacgcgacaattggcattaccattcatcgctgctcattttccagtcatcgatttatctggtgacttccgcttgcatgatccagagcaatatcagcggtggtaccaacgtgatccagcatcggcgaccgctttggcgcaggcgagctacggcttagctgatatgccggcgccgttgtccacctacattgcgaatcccggctgctatgcgactgctacgttattaggactagcgccacttgctcagcagcagttggtcgaaccgacttcgattgttgtggatgctaagtccggcttatctggtgctggcaaacgagcgacagctgcgagtcattacgtcgctgtgaatgataatttgagtttatataagttgaatcaacatcaacatatccctgaaatgatgcaacagttacagcagtggtggtccgcgatttctgcgattgaatttactaccactttgattccagtaacgcgtgggattatgatgacgatttatgccaaagcgaagtcagcattgacaacgacgcaggtccgcgctgcttttaccgcgacctatcatgagcagccgttcgtgcaagtgctaccaacggggatgccgacgctcaaggacgttgttgggtctaataactgtgcgttaggcgttgattataatccggtcacgaacaccatcgtggttgtgagcgtcattgacaatttgatgaaaggtgctgcggggcaggccgttcagaattttaatcgctattttgatttcgcggttacggccggattaccgacgttacctgtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggactgctgctgaatagtgcaatcgccaattcttgtactggcgagcaggggtggcagaatgcgctgcaagaacaagcctggttagcgaataaactaaacgtggtgccgaacttgattggcgttgcttcaactgggctgattggtgctcagttacccatggataaaatcaaaaacggcttgccgcaattgacaccaacgaagagtgacgcggtgacctacgccgtgttaacgacagaccagcatccaaaaaccgtctgtgtgcagtgtgaactcagcggccagttagttaccttgaccggttttgccaaaggttctggaatgattcatcccaagatggcaaccatgcttggttttgtcaccaccgatgcccaaatagacgggccagttttacaggacatgctaagtactaacgttgatcagacattcaatcaaattactgttgacggtgacacgtctactaatgacatggtggtcacgttggcgaatggtctggcagataatccgagtttacaagcgggtaccaccgactatgatatttttaatcaggcgttgcactatgtcttaggccaacttgccaagcaaattgccgctgacggtgagggtgcgaccaagttagtcgaatgtaatgtggtccacgccgctacaacgtttgatggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcggtgcaggcgaccttacgtgataaccagattatgatcgatgttgatttacatcacggtacagcaagtggtcaggcttggggttgtgacttgacttacaattacgtcaaaattaacgcgagctatcatacttaaacggaggtggtgaaaatgacaaaattaattgtaattaagattgggggccaggcgattagccaattgagcaccactttctttgaccaaatcgcacagtggtaccaacagcattatcagattctgatcgtacacggtggggggccaatgatcaatcgactgacgaatcagcttgctttgcccgtgcataaggtgaacgggttgcgggtgacggatgcggcgaccttagtgctcaccaagttggccctgctaggagatgtgcaaccagccttacttgcaaaattaacgcaacatcacctacctgtgttggggctcaatgcggcggataatcagttactaactggtgaattgattgattatcgacagctagggtatgtcggtcggctcaccgctgtcaatcaagtgcaattaatgcaattgttggctcatcatatcggtattttggcccctttagccttaaccgagacgggacaatggctcaatgtcaatgcggatatggcagcgaccgtgctagcccaacaactacatgctgaaaaattggttttgctaaccgatgtcccgggaattatacatcacggtaacgtgatgacatcactatcgccacaacaagctcagcaattgattcgaacagctgtgatcaccgcgggaatgcaacccaaagttcaagctgcaattgccgcgattcagacgggagtcaagcaggctattattacgaatgcaatcgatcaaccaggaaccgcaattattcaggaggtggccgtatgaccatgcaacacgtgtttccaacctatcaacgttttccatttgccattacggatggtcagggcgttcatctgactgataatcatggcaagacgtatttagattttacggcgggaatcggggtctgcaactttgggtatcaccaaccacaaattcaggcggccgtcacccagcagttgacgcatatctggcatacgtcgaatttatacgaaaatgaattacaagatgccgttgccggcctgttagcgaatggtgaagagcgactcgtatactttgcaaattccggaaccgaagccaatgaagctgcattaaaactcgcacggaagtacacgggtgaaaccggcatcttagcttttcagcattcatttcacggtcgaacctatggcgctatgtcgatgacgggcaatcctcatattcaggctggctatgcgccattagtgcctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgttttgttgattattgatgaggtgcagacgggaatcggtcggactggttaccggatggcctatgaaggttacggcctggatcctgatatctacacggtcgccaagggcttagcgaatggcttgccagtgggggcaatggttggtcggcggcaattagccactgcctttggtccgggcagccatggctcgacgttcgccggtaatgctgttgctatggcggcggcaaaacgtgtcttgacccaattaacaccggcgctgttaacgacggttcgggcccatgccgaacttgtctggcaagccctagcgactcaagtcgaaccgataccggtagttaaacaaatcacggggaagggcctaatgattggaatccacttagatgaacaaatcccggttaatcaagtcattacccggctacaagtagaaggcttattgacgttatcagctggcgataatacgttacgtttgttacccccaattgtgatgcaaccggccgatttattagctgggattgccttgattgcaaaggtactgacaactttgacaacggaggtcacgacgaatgaataatcaatttgaaggtcggtcattcttgaaggaaatcgactatacaccaacagaattagcttacttaattgactttgctagtcacttgaagacccttaaagcacaccatatcccacacccttatttacaaggaaaaaatattgcgttgctgtttgaaaaaacgtcgacacggacacgttctgcgtttactgtggcggctaatgatctgggcgcgaatccagagtttttgggtaaagacgacatccaattcgggacgaaggagtcagttgttgatacggcgaaagtactggggtccatgtatgatggcattgaatttcggggctttaaacaaagcacggtcgaagacttagcgacctatagtggtgtgccagtctggaacgggttgaccgatgagtggcacccgacgcagattttagcggattttttaacattaaaggaacattttggtcatttaaaagggttgacgttagcgtacgttggtgatggtcgcaataatatggctaatagtttacttgtggcgggagcgatgctcggcatcaatatcgctatcggggccccggtagcgttacagccagccccagcagtggtcgcgttggcccaacagtatgcgcaggcagctgggagcacggtcgtgattacggctgatccgcaacaagccgttactcaggctgatgcgctttatacggatgtctgggtctcaatgggcgagcaggtcgactatggtgagcggatcaagcaactattgccgtttcaaattaatactgcgttactcgcagctactggcaagtcatcgacgattgtcatgcattgcttaccagcactacacgatctaaagacgcagctgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattagcaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaacgccctagtcgctgcaatgtatgttgtactatgcctaggccccgcagcttttagcttagcatcgggcgcaattcaattccgcgtttctgaagggttgaaccacttagccgtgttcaatcgcaagtatatttggggaattgttgctggcgttattttgtttgacgcttttggtcccggtgcgagtctcctcaacgttctctttggtggcggccaatcattattagccctgctggtattgacgtggttggcccctaaattgaagacggtttggcaacggatgttactgaatatcgcgctattcaccgtttcgatgtttatgatcgcactgatgattaccatgatgagtagtggtgtcgctttctggccgacgtatctaacaactgctttatcagagttgattatcatgagtatcactgcgccaattatgtacagcttggatcgggtcttgcactttagtgaccggattcagtagggtgtgatttttacaaatcagactaaaaaccgttatttcgatgaaggatgagtcattgaaataatggtttttttgtcgagtcattacgatgtcagttgaacaaaataatctaatcgactcatagtgaagttggcgatgagagttcattatgggcagatatagtgcataatgactggtgttcatttcagaacccagacaattatttgaagtaagcacgcgtataatcgttttcgccaaccgcatgatagctgacaccatttaaattagaatttacaaggtgactttcagtcatgttgtaaagcggtacgactgctgctgtttggttgagacgtttggcggcagttctcatattttgccagtatgattgtgtgttagttgcgttctggttgtgtgcagcggtgatttgttgattgaaaacagtgtcatcatagtgcccgtagttttgcggattgttctttgtcagaatgtcgaaaaaggaaatcgggtccgcgtagtctgctagccagagtgtataagtcaaatcgtaatttccgttagtaactgcttcgccggaggcctttgaaggtatcgctgaaactgacattttggcatgtttcaggttttgtgctacagcggcttgaacaaactggtcaatattcttagcgaccgtcgtgtcatcactaactagctttaatgttacagaagaacggtcaagttgcttgagacccttattccataatacttgtgctttagcaacattgtgtcggtaggtgctttgagtttcagtaccaaaatccttgcccgtagtgggatcggtggttaaacctggtgtgacataattgtaagcaggtgttgaaccatcactcaaaatatttttggtgagtgtttttttattaagcacaagattcaaggcttgacgtaaatattgattgtttaaagcccgatttttttgcatgttgagacgtaaataataagtgccagctttactgacgtgtttcagatgcgagtcattttgaacaccctgcgcggtgacgccggtgacagtagcgtcatctaatttattttgtgagaagagattatgggcagttgtggagtctttgacaacttgcattgttattttatttaacttgatgtcacttttatcgtaatagtatgtattttttaacaaattccaagaatcattagtcccgttccaacctttaacggcgaacgggccattgtaggccatttttgtactagtagttccgtaatctttcccgtatttggacaccacttgatgatcctggggaaagaaagcgggcatggtgagcatcttactcaagtatggcatggcgtggctgagcgtaacttttaaagtgtgcttattcactgcagtaacgcccaatgatttaacagatttatgtccggctgaaatttgagcagcgtttttgataccttcgtatatgtaactataaccagaggtagaagtggcactgacagagcgttgccaagctgttacgaaatctttggcagtgacggtgtgaccattactccactttgcatttcgtcgtaagtgaaaggtgtaggttttgccatgatttgttggtttaacgactttagtggccattgcaccgaccactttattctgagcgttcatgcgatagaggccttccatggattgttgtaagacgttccattgtgtaagtgtggctgtatttgaggtatccaatgaggttaattcactatcctgcatcaaatgcagggttttcctggtggttgtgacattggcatgtgcttgcccacaagcggttagactacttagtactagtaaaaggcaactaatagttgtcaattttttcatcaacattagcgttcctcctcaattaatatgctgtaaattgattggtttcgacatcggtgagatagcgtctcaagctatggaagaaagcggtgggattatctacactatgacaatgaccaccatctggcgttaaagttaaccgtgcctttggaagagttcgctgcatacgccgggcaactgatagcggcatcgtgtcgtattccccaaaagtgagtaaagtaggtgtcatgattttatggaggtttgcacgttgatcccagccatttaatgccccaaccatcacgaattcgttattgccctgaaaataattataaacaggggtagctagtgttgagactaattgacgaggcgcattttccggatgacgacaaacgaagtgccggttgagagtcgtgacaaggcttttgtattctggatcatcaaaggcctccgcgttttcaatatcttgcatatagctaacttggctcgctattaacgtttgttcgcgcaatttattgacgtgtggtgtgtattcagcgatgttatcaatcatactcatgataattaagcctttgaggtgctgaccatatttcagagcatattcttgagccaataagcccccccacgagtgaccaagtaagtaaaagtcttcgagtccgagctgctggcagacttcttctaattcagacaaataataatccaaagacaagaactgttgattttcaggccttgaaaagtcaggttgatctgagtaaaaggagcctaattgatcatacatgctgatttgaaaattttcttcacctagctcagtggcaaagttttcaaattcagtatgattactaccagggccaccgtgaacgcataatactttgactggcccgtgaccaactgtccgagtaaataaatgaaaaccattttttagctgtattaaatgagttcctgttaacatagaaattcctccttcgattagacaataaaaacgccctataccaatcaagtagttgattgatatagggcgtttccgcggtaccacctattatttgccagtaaactggcctcacttcacgcacggtaagttaagtgacgatgcgctagcatgataatggatgctgccattaagtactcacaaataatgatcgcacttaccgtgattaggggattttcacaagatagcaatatgaattcctttcaccaaccggaacctctctgaacaattgcttaagtgctactttcctaatcgtcgcgtttaattattttctaatctttatttaatgttgactactttatcattgactattatgtttgtcaaacgattttagataaatgatattggtcgttaaaattagcaggtagatttaaatagtttgaaattagtcagcgataatttaatgcttcatcaagattccagtgtgtgttctactaagacttccggagctgggtgccaattgctggaacacagctgacccgaacacgtttcgtcaatatggcattagggagtgaacggccagcatttgagacgcgatattttgactcaaatctgcgcccaccacgttccgacaattgacaaaaatacctgtaagtcggtggtaggacgcttcagccagacaggtttacgctaattcgaactgttttcagcagtcttaagctggtcgcttttgatctgaaaattcatctcattaaaaaagccccaaggtaacctcggggcaactgtgattattcagcttgtaaatcttccacttcgatgactttaaattgtttgcgattcaagttgtcgataattcgtttgagtttttcactgtcgacattttctggcaaggtaaagagcgtccgataaccgagtgtcccgttttggacgtctaaggtcaggcagccggcgattgaagtatatttcgtgataatcttagccatggctgcaaggtcgccgcgttcaccaacggagacaactgttaaaacatagctaccaacgttaacgttccaagattgtgagagcatgtcgagcagacgcgtatgagtgagaatgccatagaaatagccgtgttcatcgagcaccgcaatgtatggcaaatctttgatggagaagaagatattgtagaaggcggagtcgacttgaatcgttttcgtggcatttttaagcagggtcgtcacgggaagcgacatgtcgccgccccgagacttgtgccgatagatgtgcatcttatagatgttaccacggaagatatgaccggtttcatctaagattggaatacagcgaaagccggaatcctccaagacttttaaggcgtcctctaaggtcgcgtccgccgtaatggtgacgaggcgttctttaggctttacgagtgtttttaatagcatagcagttggtcccccagatttattagtttgttttaataaataataccataaaacgaccgcttacacgtatcattatggcatcaaacgacggctaaaagggatgaaaaagccggcctgataacattcagaccggcttgattaaattagatttaaattagaaaacaatgactggtgttccgactggcacggcagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggaatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagctttccatcaacgtagacgtacatatgctgattttctttatcaacttcgacgtaggtgttgccgatgtcagtgcccttgttgttatatccggaaccactggtgattggtgagcgggtaaagtccttgcccttcaaaatttcagtagcaagggctttggcctctgcttcggtcttaatggtccagccataaaacccaccgctgacggatacggtcccacgcgccgtactcttgaactgacgcgtcgtatgataggtatgatacttatcattcaattgcttcacgtaagtcagaacagcgttttggtctaaacttactttgccttgcttatcgattttaatccaactgagaattaggtcgtgaggaatcgtgaatttatgaccgttgatattataggtggccttttcggtagcgtatttcgctgattttactttggccgtctttaaactagcactcgtgctggtaacggtcggagtgacgtaggcgtctttaagggtgatatgactgtcaccattactaattgcttttgtgacgaccgtcttaagtttagcttgatctaattcggttccttgaacttctttcttaatctcaacttggttatgttgataaactaacctggcgttttcagtttttgttcgtttggtttgattggcagtcgtggtgattttttgtagtagggttttcaaatcagtgtgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttgaccgttttcaataattcgataagtgcgatgttctaaagcgcgattaactttcggtgctgcttgaacggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcgtgttgcgctttaatgaatcgctaaggtaccctcaagcaaaaaaaaaacgcccgtctgctatagacgagcgttcatcatacatttaatcgtatgaaatgattatttattttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggctttggaaatccgcattaaagcagtcccaataccgtagaacgtggcacccttcaagttgatgatgtcgtaagctttgttacgaacgccgtcttctaacttggctaaatcttcgtcagaaacgccttgttccttagcaacatcgcgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttgaggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaacctttggcgggcgtcaataagccctttgtggtatacttatcgcacttaataaacgctaacttttgaacacttgactggcgggcgcgtcggtcactgtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtaagaagattttactggtgaaacccgccacttatatgaatgattctggacgagcggtgggaccgttgatgagctattacaatgttgatcctgctgatttgctcgttatacatgatgatttagatttaccattaggaaaagtacgcctcaagcaaaagggatcggcgggtggtcataatggcatcaagagcattattagtcatgttggcgatcagcacttcaagcgcgttaaagttggtattgaccatcctcagaagatgagtgttgttgattacgtgttgggaaaatttacgccagccgaagtggcaaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcagcccgcgtagtcggcaactaatcaccggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgggtccaggctttaaacgccttattgcgtgacagtccggcagtggtcgtgacctcggttgcaggtgcccggcggttcttgccgcccgtcgcacaatttcaagcagccacgttaccggtagccgttggtcaagatattgatttggaagacttgcagcggcaactacacgacatgggttacgttaaggaaaagttagtcgcacgcccaggagattttgcggtacggggctcaatcgtggatatttacccgttagatgcggactaccctttacgactggacttctttgatactgaagttgatacactgaagtattttgacccggaaacgcaacgttcggtggaaaacttggatgagtatacgattttaccagctaccgactttatcctaacatcagctatgctgcaggccggggcacagcgtcttaaaacggcgattgcggctgaaagtaagaaactcaagccagccgaacgccagactttggccgataatttagcacaacctttagctgacatggaaaaaggaattatcggaaacgatttattattatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgttggcaactgcgagttacggcaatgatattcgggatttgctccgggatgaccaacatgcacaactcttgatttcgctgtttcaaaagggcatcggcaacgtcaaactagcgcaagtaactaacgtgcgcacacgcccgatgcaggaattctttgggcagctcccagcgttgaagaccgaactggatcggtggcataagcttaaacagacggtggtcttgatggtatcagaggctgagcgtctgacaaaggtcagtgatacacttgatgattttgaaatcgaagcggtcatgactaaggccactaatttacaaccgggggcggttcaaatcgtgcaaggtagcttgcaaaatggatttgagtttccggatggtaaattagtcatcgtaaccgagcaagaaatgttcaaaaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctacccgattaacgttggcatgctgtcacgattcagaacaactaaggaaatgaaagagacggtccaacagttaaagagtggtgaaattgacatcgtggttggtacgcaccgcttactgtctaaggacgtcgcgtttgctgatctgggcctgctcattattgatgaggaacaacggtttggggtcaagcataaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggtcttttatttgcataaccgggttcatgatattgataaagtcgttgcacagatcaaagacttggttcccgacgcggcggtggcccatattgatggtcagatgcctgagtcacaactcgaagggattctctacgatttcattcggggtgagtacgatgtgttagtgacaacgacgatcattgagaccggggttgatattccaaacgtcaacaccttatttgtggaaaatgctgaccggatgggactgtcacagctataccagttgcgtggccggattggtcggagtagtcgggtcgcctatgcttactttacttatcagcaaaataaagttttgacagaagttggtgagaaacggttacaggccatcaaggactttacggaacttggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcgatttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggccttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtgcgtcttagctcggtagttgttgttatgaagcatggttgcacggggtgggttaagcgctatcgagtggaaccaatggaaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcccttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattgtcgttggtcgtctttttcggcttgcagcttggtgcaacgtggattgcggcccacatgggtgacgttaatctagcaccaatcattagtgccgtggcttggatgtttgtctttatgccatggttagcaacaggccgtggttactatcaaggaaaatttttgatgggaccgaccgcagtgtcccaactgatcgaacaggtcgtacgggtcgcaattatcatcatggctgcatatttcagtgtccgtctcggttgggataattatcggatgggaacgtgggcaatgagttcagcgccactagctgcaatctgttcatcactgatttttactgcttttggtctacgctatttattggcgcccgcacccgcaccgacccacccattacctagttatcgcaaattaaccaaaagatttgtaattgaaggtgggacgctgtgtcttgtcgccgctgtcgttatcttactgcaattagtggattcatttacggttatgcggggcttggtacatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatattattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtacggtgaccgtattgagcttggccgtgatgtttgcggtcatgtggttaggttcgccggaagacttgcagcaggtgctattagagagtggttatttgataaaattgctcgcattaagtgccgtaatgggtatcgtggttgtccttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaagtcttccagtaatgttagcgttgatgatgaactaattattagttttggaaataagacattaacagtcaaagtgacgcagttattggaaacaactaagaaaaatgatgccgagctgatgtatgacatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacccaatttgaaaggactggaccaacatgacgaacgggtcacataacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccaatcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgccgatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaatccgtaaagcggttgacaaacctcaaggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggcttcttaaaagatagcgaggatcggctagcaaccttaaagcgtaatactgaaggtaagcgtggtggccgtggtggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacggtgtgagttactgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgaagctagtcatggccgattggctacccgtggcacatcccaagagtggtattgaagcagctgggcgtcagtttcggtaccatgtttttgctaaggtgatgcgggaaaatcgtgcaacggcagttttgactgcgcaccacgccaatgatcaagtcgaaacgtatctgatgaagcttgcgcgtggtggcgacatctcacaattgacaggaatcgcaactagtcggccctttgcaacgggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccggttattaaagcatgtggccgattaccagcaacagttgacaacgctgttgacggctaaaaagcaaatggtcagggtattactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacgggtcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaaaatcttagttggtcgtccagacgtcaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgaatcacaccgtgaacagcataagttaattgcggaagctttattgaagtacgaaacattggatgaaaagcaaattctcagtctgtttaagactggtaagatgcctgaaaaggatagtaatgaattcccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccactggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgcgttaattcggttatgagcgtcgggtcgcaattaaagacggattgagataggagtatgattaaatggcagattgtttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttaaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacaatccgaacagattccatcagctgttggcttgtcggtgtttgtaaatgaagacaattcgattggagttgccggtggctttttggtgcaagtattgccaaatgcgacggatgaagccatcagctcgctagaaaacaagctcaaagacatgccattagtctcccaattgatgcgtgatggtaagtcaccagaagatattttggatttgttatttgatggtgacgttaaggtattagataaaatgccagttaagtttgaatgcgattgttctaaagaacgatttgccgaagcactaatggctttgcccaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggttagtcgtttgtgagatgatttctgatcgcgggatcatgtatcataatcgtaagaccctggaaatgatgtttgttgatccaaaagaacatccaatgagtattcaaatctttggtggttcgaaagcaacactggctcaagccgcccagtttgtcgatcagcagaccaatgctgatattattgatattaatatgggctgtccggtgaataaagtggttaagactgatgcgggcgctaagtggcttttaagtccagataaagtctacgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctgcgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgagcggggcggatgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgaaccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggactcgattcgtgatgtcttacttttcccaacgatgcgtccagaagaagataaataattagatttaaaacggcagttagcttaggttttcctaagctaactgccgtttttgttgggtcagattgagtaactttagttcagaaagcaatttattgaaaaaaagttagattatttttacccgaacattgttgaggcagttgggggttaaacttaagtaaaagcgaattttatggtggtggtaggtaggatttgaagtcaattaacatgattatggttttaaataccgtatattatcaaagtggattgattaacatgatattattgactggttatttttgcattttagggcttgcaatttatcaggataattggtaaattagtatacgttgttgaggcgcacaaagcggttagccgcttgcttccaacgaaaattaattataaaaagttgttgacaagatgttgatagcttgatatgatgattaagttgcgttgaggtaatcaacgaacgatttagacctttgaaaactgaacaaagtttcgacgaatcaaatgtgtagggtctcttgattttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggtactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaacctttttaggaaccagccgcctaaggtgggacagatgattagggtgaagtcgtaacaaggtagccgtaggagaacctgcggctggatcacctcctttctaaggaatattacggaaacctacacattcttcgaaactttgtttagttttgagaggtctaactctcaatttaataagcgttttttgggcctatagctcagctggtttagagcgcacgcctgataagcgtgaggtcgatggttcaagtccatttaggcccattggaaccgaaccagttggttccataagttgaatacctcatggggaattagctcagctgggagagcacctgctttgcaagcagggggtcagcggttcgatcccgctattctccattgacgacgttagtcgtcattgaaacttgttctttgaaaactagataatatcaaatatattttttcataatgaaaccgagaacaccgcgttttttgagtttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgattctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattagctagttttgagagcacaagtttctcaatagtgtggtgacgatggcgagaaggatacacctgttcccatgtcgaacacagaagttaagcttcttagcgccgagagtagttgggggatcgctccctgcgagggtaggacgttgccatgcgattattccgacatagctcagttggtagagcgcttgactgttaatcaagatgtcgacggttcgagcccgcctgtcggagtgacatagatgttggcaattgtgttaacatctatttttatatcatgccggcttagctcagttggtagagcatcggtatcgtaaaccgagggtcatcagttcgactctggtagccggcacttgtgaggtgggacgtggttctcgcctttttatttttaaatagacataaaatgattggcagctttgcgcaaacgcaaagctgcttttttgatataagaatgttagctatttgaatgccgaagtatcaaaatgatcgtaagggcttagtaagatgatgcctattttcgccactgctttttaggtatgcttagcatatcaatcttgcggtttatcataattagtcgcaataactgtaaattacatgctacgaacaatcatagccattttaatagcggtactttattgttgataatttcagttttgtttttttgtttaattagatttttaataccaattgcgtattttcagcatttgaatgctattaattattttatattaaattagaatttagtgttaattttagaaagctaaaagccttataaaatgtcctatcaactagttttgggtgctataaaaggatttaagactatttatgtatggtggatattaatttaattaatggttattagattagaaaacggttagtgctattgttgattaagattaaggctagtataatagttattatgtttaattaagaaacaaaacttgttacttttaaacgaaatacaaactggttaagaagtttggaggaatctctattggataaggaacaaaagctggatcggtcgttctttggccaaccccgtggcttacggacgttgttcttcactgaaatgtgggaacgattcagttactacgggatgcgtgcgctactgatctattacatgtactacagtgtcgctaaaggtggtcttggatttgaccaagtcaccgcagcatccattatgtcaatctattcggccttagtttacgtttctagtgtcctcggtggctttctaagtgaccgtgtctggggtagccgtaagaccgtctttattggtggggtcttcatcatgttaggccacatcgtgttatcaacgccatttggagttggcgcactatttgtttcaatcgcacttattgtcattgggactgggttattaaagccaaacgtctctgacatggttggtcaattgtatacagtagaagatacacgtcgggatgctggttttagtattttcgtcttcgggattaacttaggttcattggttgcaccagccttagttggtcggatcggcttaaatgttaacttccacttaggcttctccttagctgcgattgggatgttctttggtctattgcaatactactttgatggtaagaagaatttaagttctgctagcctctatccaactgatccattagaacccggtgatttgaaaaaaatcatgcggtggacaatcttaggaatcgttgggattgggttgattctactattaatgcaattaatgaatgctcttacgttagcaaatgttattagtttaattagtacgcttgttatcttgacaccaatcgtttactttattttgatgttaacgtctgacaagactaatgcaacagaacgttcacgtgttcgggcttatatcccattgtttattgccgctgctttattctgggcaattgaagaacagggttcgtccgtacttgcgttatttgcagctaaccgggttaatttggatcttggttttacccatctagctgcttctgatttccaaatgctaaacccattgttcatcatgatttatacaacaccattcgtgtggttgtggactaagtggggtaaaaaacaacctagttcaccaactaaatttgcgattgggttgctattcgctggggcttcttacctagtgatggctgtacctggagcgctctttggaactgcagggaaggttagtccatggtggttagttgccagttgggcagtcgttgaaattgctgaaatgttgatttcaccaattggtttatcagttaccaccaagcttgcaccaaaggcttttgcttctcagatgatgagtatgtggttcctaactgattcggttggtagcgcacttaatgcacagattgtccgtttctactcgacgcaaaccgaagtgccatattttgcgattaccgggattgttagtgtcgttttagggattatcctctttatgatggtgccaatgattaaacggtcgatgcaaggcattcgctaaattgaatatttactcgaagatatgttatcttagtggtagcatatcttttttgggtagcgtcaagaatcttgtgtaaatgaaatgccttcgtacatataatatgtatctaacttaaataaatgatgcttccaaggtgtcctggagtcctttgaaccctcggtggatccgcttaagagacttctcgttataaacattaaactgagaaactaggaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattaagtttcagttcggctgcttcacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgatcaaggttgccagcagttcagtccagattccagtcgattccgttggcgccacttggtagttcagcacttctttcgtaccatctggacgaatgccaatcgcaatatgaacggcttctttttgaacggtatcccgctttaacggcaagtaagtggcatctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttagtcccagcgtatgagtagcgttcgtaacccaaaaactctgccaattcggtttgaagcagctggttaatcgcaatttcgaggtggtgacgaaaaatttcgtccaaatcttgcttttgggctagtgcagcgataatttctgtggtaagttcattcatggggaacgcctcctgtgatgttttctgtggttactaaatatcataagggaaggcattccctatttctatacaattcagaaatcttttatgcatttacacaagatattttacgctctccttttttgttttggaggggttgaccatcgtacgaattgctttcagtagtgataatcattttgatgttaatcgagtggatgcgactgcgatgatgcgatctcaggcgacctatcttttacagaatggtgttcagatttatttgattgctggcgatctttttaatgactttcagcgtagtcagcagtttgtcgtcgatttacaggccctattaggcgcacagacgcgtgtttactggattgcgggtaatcatgacatggtccatggcatttcgtttgacgagcttgaaacagggcattttgatggctacctgcataaccggtatatcgatatttctggtacagattggcgcgtgattggacataatgggtggtatgactatcagtatgctgcccaggtccctgatacgactgcggccgacttcttacactggaagaatgcgttttggatcgaccgggctattaaacagccgatgagcgatcaggagcggactgatttaatgctcaaccaagtaaaagcgcagcttaacttggctgctgtggatcacaagcaagttatttttatgacgcactttgttccccggatcgattatttgcgtttttctgatgataatcggttttggaatatggctaacgcgttaatgggaacgccccggttaggacaactgttggagcagtttaacgtggcgcacgttttatttggtcatttgcacgtccatccgcaaccgcgggtgtttggtcagaccacctattatgaccaagcagtgggctatggactcaagcgtatcaatgaatggcaagccaataattttatggcggagtggtatcaagatacgcaaattctggatttgaaataaaaactgaaaaaactttgaaaaaagtcttgatttttcattcaaaattatgtattctaatatagttgaatgatttacggaggggtagcgaagtctggctaaacgcggcggactgtaaatccgctccttcgggttcggtggttcgaatccactcccctccatttcattattgggctatagccaagtggtaaggcaacgggttttgatcccgtgatgcgctggttcgaacccagctagcccaattgttacgcctttcgtcgttaatcaggtcttaggatcttgatgtaacgacttttttattggcttaaatttattttaatatcggcgggtagtgccacttcgtgaagaatgcgtaacggattcttcatgaagtggatttttttgtctcggtctgtttatttgccatcatcaataataatgtgatatgttttagtattctatttggggcacgatccagatgggataggaggtctggtcaatgaatttatttattccgtaagtacacggaagaggttaatggctggcattgttaattttaaaaatacgtactagttaacgcgtcatgacggccatcacaattattatgagtcgttcttataaaagcacaccaatttttaaagcacatatgggttatggaaagaagcgcgctagccgtgctgttcgaaatcgtatgaatcgtggtgaatttgatgatttgccggctaattcgcatgcctggtataaacgatgttatgagcagtatgatgttgtcgattattgctccagagagacttattcgcaagttcaacttgagctggagacgatgcgattagagattactcgtaacggtgggattattcgaagaatcccacaacatctggttgttatgtatacttttgatccggtgatatctgatattgtgcacatgcagcgaacggaagaactaattcctgcgcaagatgtccaaatgtttgtaggtacttttgaacagtggtgtcgggagcgtcgcaactgctgggccaaggcttattatcgaaaataagtcgtattggaacttgatctatgagatttggttgaagaggctacgtagccttagttgtcccactaccagccccaactagttgactgaataaatcaaattttccacagaactgttatcaaatgtagtaacggcagactgttcagcgtcgcaatgacgcttggacagctttttgcatggcccatatctggattcaaaggcatttacctgccagagatgacgtggttattaagtatatgactagcagtcagttattcagaattataagatgtttattcaatcgaacctcgaaaattgagtttgttagcgttaagcttaatttaagaaatcataccatcatgaataacgtaagcgaccatgatgatgaccaaggaggatttgaaatggcggtaactaaaattgatttaaaaaccacgatgacttaccgggagcatgcaattactagtaaatcatttgctcgaaaattagggattgaactgccgtttgcgatgtacgcaatggcggcgggtgaaagtattagtgctgaacaatccacgctgacccgcttatttgaggttgttgatggtactttgaccgtccgtttggcgacggagaccgaccaagaagtgcatgcgggcgagatgttagtggtgccagctcatacggtccatacgttggtcgctgagcagccgtgccagtttattcaattagaaacgaaataggccttaatagcgagatgcggaggaattcaaatgagtttaattaacaaaattgatcatgctaaggtcctcaatttaactgaacaaattccactggatgatgatcaagttaatagccggacactggttcaacgggatgatttaagtatgacgctattttcagtcgcaaccgaccaagagattggcggccattctgcccagggcgatgcgatggtcaatattttaagtggagaagcggaaattacgattgaaggcaccatttatcatttaactgcgggacaatcgatcgtgattcctaaggatgcccggcacgcgttatatgccgttcaaggatttcagatgttattggtggtcgttaaacccgactaatgcacgtggttatcgatgagacggagggagtaatatgccgctgtatacgtttattggtgatattcatagtgccgcggatgatctggcagttttattagccgatcctgaagttaccgcgacgcgcttgattttcttgggcgattatattgatggtacggcgacacgctattttggtcatgccaccgagtcagctccgttggcgccgctaaaagtactgacgatggttagaaaacgggtacgggaatacggcgatgtggctttacttggcaatcatgatgaattttggctacggacagctcatggtgatgacaatgccaccgcaacttgggtgttgaacggtggtcaccggacctggcgcaaattagggatttactcctccaatcccaatcatgttcggcgggcattaaatggtgcgctattaaagccggatactgatttcttagcacatttgccgctgatgtggcaacatggtcggttactggctatgcacgcgggtgttaactggcaatacccattaacacaacaaacaacgactgacctactgtggattcgggatgactattatgatgacttcacgactggcagtcaccgttggcatcggaacttattcaataaagtcatcattactggtcatacgccggtgcagaccttgactggttcacacactggttatttaaagatgcaggcagatgcgcaagacgttccacgatatctaattgatgcaggcagtcgttcaggcctgtttgatggtggaatttgtgcgttaacgctgacggtcgatggtgaatttgtcagggcgaaacgcgtgatcaagggtcaccgctacgatggtcagcaaatcgtcactccggccatgttggtggatcaggcgcactaagtatcactaaacatctcagagatagaacgtaaaaggagcaggctcacatgatattgagactgctccttttatgatgtcacgctagttactggttttcgcactatttcaagttgattggtttgcaagttctcactgaattgttactcagcgtaactgaattatagttgtaaatagaaccagccaccaaggcctaaaatgaacaggccaagtccattgagggccgtaaacacgatcaaaaaatggtggagtggttgttcatcattgaagggcaacaattgttttaaggcaagcagatttgctagtgaggccaccaatgaccccagaccgccgatattgacgcctaaaaatagcgctgataaatggggcgtgaaattcgctagtaagatggcggctggaacattgctgatgacttggctagtaattagtccagtaatatagacactgggggctgtctgagtcaattggttgagccaatgcgttattgcgggattatgactgatggcgctaacgaagatgaagaagcagataaaggttaagagtagtgcgtaatcgacgtactgaaagacgcgtcggttaatcatgaggcctacgacaatcgttccgataataactagtgaaatgggcaccaaattaaaaatgccaagcataatgaaactgagcaggccgcccgcaagcccgatttgactgcgagaaatgggcgtagatttggttggtgttacagttagcggcaaccgaggtaaccgccagcttaaggcaactaataaagctagactagcaagcattaacggggtcgataatttaaaaaacgtgaatagattaacgtgatagaacgtgaccaaaaataaattttggggattgccaatgggcgtaaacgcgctaccaagattagctgccatgataattaaagtcgttgggtaggcaatggccaggtgctgccgccgggcgagtgtgagaaagattggaattaacgttaggatcgcaacgtcgttagttaaaatcattgagccaccaaaggccagtaagatgaataattgacacatttgacgggtatcgtgtgatttaactaagagccagtcccttaaagtatcaagcaaatgcatcgcgcgaagtaattgaacactgatcatgagtgcaaataaggtgccaatcgtagcccaattaattgccgtcagttggggtgtcccgatgaacaaacttaaaccagcacaaattaatgcaataataaagattttgtcgtgaagtgtgcgacgaacgactgtcaccatggtaaacgtccccctcaatagtcagttaattagttctaacttaaacaaactcgtcgctaaatgtaaactgatagacatttttcagataaggatgtagccacccgaacggtaacccaaataaaaaatcgcttcaaagttatgtgcttaactttgaagcgattagtgcttggttttgattgccagttagcttgcttaatgtgtatctagtttatcttgctgagtgttttgaccgaagaaccacaagtaggcaccatataacgcgttagcgagcatcactagttgcaatgctaacattgaggcggctgcaggactgaagccttttaattggttgaaccagataataacgttaatcacgtcgagtgtgatccacgcaacccattgggaacgataaccgttgaccatgaggacactaccgacaatcccaagtggtaacagggtcgcgtccaggtagatttggttaccgttaagttgtttactaaagtgtaagacaatggcgtagacgagtatggctaacgcgaaccaggaacaaccggctaatttgctcaatttacgaccagtcagttcgctggcatcgggttgcgctgccattttacgatgccagacggtgatgccgacaaattgcatgataaggtaaaatgattgcgacgcaatgtcaccaatcagccgattggtgatggccgtagtaagccaagctgcacaggcaataatgccccaactatagttcgtcagtcgcccttgatcaaccagaattaagttaatcacgaccgtaatcccggtcaataggccaatccagccatgtaggctgtaatcgcggcccagaataaaaccaatgatggtcacgattagcatcgtgctcatcatcaacttagtggtgcggcgaagcgtctttaattcattaagtccccgttgccagctgaagacggcgcgcatggccgtgggcagactagtgatgtcttgctggcattgttgcagcagggttgataaggtgagtcggaaatggttgttctggttcatagtgaaacactccttagttgtttttagacagccgtgttcggaagcaacgctgtgtttgattgctgtttacattagcttgttcaagcagacctgtcaacgagcttcgcgcttattgaaggccgattattaatagattaatcaattggtttcagtattgataagcaatcaccttaatagagtggctcgtgatatttatttgttgatagtgaaagttgagctgaaaaaagtgattaattacccacagtttcacaaatattggtatagtagaagaggaagcgggaatgtctgtttaatcctgcctagccgttaatcggttagtggttaatgatataaattataagtcagaggagcgttttacggatgaaaatcggattcattggtgccggtaacatgggccgcgcgattattgatgggtggttaaaacaacaagcggtcgtcccagcagatatttatattcacagtgcccatgctgcgagttatcaaccttatgcgcaaaaaaatgggctacaggcctgtgacactaatttggccgtggcacaagctgctgacgttatcgttttggcagttaagccgaacattgcgttggccgcattaaaagaagttcaagcagctttaacgggcaagtgggttattacaatggtatcagggttgagtttggccgattatgccacggttgtccctgatctccccgttctgagaatcatgccgaatgtgaacgtggcgattggtgccgggatgacggcgttggttggtaatgatgccttaacaccagagcaatatgcggctgggcaacaattattcgatgcgattggtgccacgagtgccatcgctgagaaagattttccaactttttcagccttagcaggtagttcgccggcctacatctatttctttattgacgcgatggcccgcgcaggcgtcaagcacggtttgagcaaggatgcagcgactaagattgcggcgcaggccacgctgggcagtgcgcagaatgttttagcttctgataaaattccgtttgacctgatcgatcaagtttcttcacctggtggcacgacggttgctggattactggccatggaagaggccggctttatgaccgcagtggtgaagggaattgatgcaacgattgcgaaggaacttggcgaatcttaaattacttggtgctggtggttgcaagcttggtctataccgattataattaaaccagataaatccaaggaggaattgttcatgagcaaagtgttaaaacatgccatcatttatactggtctagaaaagatcaatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagatcattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaagttgtcgggtggtcgggttaagttgattacttacgcgccggaagatcctggttcgcgtgaatttgaaaagtactgcttggaaaatggcattgtgccttcagtaggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaacattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataaattagaagtaagggatgagtaccatgagttcgccaatttatattcaaatccacaaccaaattaagcaggcgattgaagcaggtcggtgggccgttggtgaccggattccgtctgaacgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttggaagagaaggcaagtttagtgcctggtaaggctcaacagactgtttcggcgatgtctgcttctgagcgtatcgcagaatacttgtcagtccggcgtggcgatgcgttgctacggttacggcagatttcgtatttgcaaaccggcgaaccgtttgaatacgtgcggacccagtacgttggtaaccggtttgagttttatcttgaaaaataaccagtcggtcgggtgctgggcacctgattagagtggtgataccaaaaatagctcacctaggatgttattctaggtgagctatttttgaattcatgactgaagactgggtacacgcacaaaagcaattgtcatcgtaacgcagtggcttataactggtaatgattgccagttaatgggcttgctggcgcgctatttttttaactaaccgcaagtagcggggtaacacgagcatccgcttgaaacgacttggttcttgaatcagacggtagagccattcaacgtggtgtttttgccaaaataacggcgcccgcttaaccgcgcctgcaattacgtcgaagctacccccgacacccatccagagcgcatcgaggcgttggcggtgttcagcgatgaaaaattcctgcttaggaaaaccagtggctacgaagaccatatcgggttgcgcggccacgatttggtcgacaatggtttgttcgtcgtcataatagccatcacgggcacccgcgacaacgatgccgggataatctcgttgaacgatcgtggtcacttgctttaacacggccggcttggcacctaacaaaaagatccgttggtgctgttggctaccccattctagtagtgttaaaagggtgtcatagccggtgatccgttcggggagtggtgtgccaagaatctgggccccctgaatgacgccaatgccgtctggcgtgatatagtccgcttgcgttaacacctgttggtaatcggggtgttcacgagcgtacattaagatctcggggttagcggtcaccacaaagcgattgcgatgcgcgagaatatcggtttgaagttgctgaacaaaaccagcgttagttgtcttgataaacggcacgtttaagatgttaaccgtgtcaaaagggactgacataagcgacctcactttctaatcataattaaagtataggtaaatcaaggaattctgcaactttttggatgcttaagcgcattcttttataaaaaatgctaaaataagcttaacttactgtaaacacggttattacctacgaaatggagaattatactcatgacgcaaatctatccggatgatagttttaccttgcatacggatgcttatcaaattaatatgatccaaacctactgggaacaaggtattcacaacaaacatgcggtgtttgaagtgttctttcgtaagatgccgttccaaaatgggtacgcggtatttgcgggtctggaacgagttgttaattatatcaatcatttacattttacggcaactgacatcgcatatttacgtgaactgggtggctactcagacggttttctagattatttagcgaatttcaaatttgatgcgacgattcgtgcggttcgtgaaggagacttggtctttaataatgaaccgttgttacaagtcgaaggaccactggccacttgtcagttaattgaaacggcactactcaatattatcaattatcaaacgctgattgcgactaaagcggcgcgcattaagtcggttgtcggtgaagatggcttgctagaattcggtactcggcgggcgcaagagtttgatgcggccatctggggaacccgggcggcttatattggtggctttgacgcgacgagtaacgtgcgggctggcaaaatttttggtattccgattagcgggacccatgcgcatgcgctcgtgcagacttatcgaaacgattatcaagctttcaaggcctatgcggagacccatcatgactgtgtctttctagtggatacgtatgatacgttacgtagcggggtgccgagtgcgattcgagtggctaaggaaatgggtgataaaatcaatttccaaggggttcgtatcgatagtggcgatatggcttacttatcaaaacgcgtgcgtgaacagctagacgaagctggttttccggatgccaagatttatgcgtcaaatgatttggacgaaaaaacgatccaaaacttgaagatgcaaggtgctaaaattagtgtctggggtgttgggacgaagctaatcacggcctttgaccaacccgcgttaggggccgtgtacaagatggtttcgatcgagaatgatcatcatcagatggttgatacgatcaaactttcaaataacgcggaaaaggtctcaacgcctggtcaaaaacaagtttggcggattacgaagcgtgcggatggcaagtcggaaggtgactatgtgacgttgtacgatgaagatccgcgcaacgaagaatcaatttacatgttccatccaagctatacgtatattaataagacggtcagtgactttgatgcgcgaccactattggttcccatctatgaccgcggtcaacaagtttatactttaccaacgttagatgaaatcaaggagtattcatttgaaagtctagatgcactttgggacgaatacaaacgggatttaaaccctcaggattacccggtcgacttgtcacaaaaactttatgatcataaaatgaatattattaacacggtcagagaccacgttaaccataaagatgaggaggaagcttactaatgcggccattacaagctgagattattaaagcgttacacgttgcaccaacgattgatccagaagttgagattcgtcgaagtattgattttttgaaggcttatttaactaaaaatacctttttgaagacctatgtgcttggcatctctggcggtcaagattccacgttagctggaaaattgacggagatggccattaccgaaatgcggcaggaaacgggtgatgatcgctatcaattcatcgcagtccggttaccatatggcaatcaagcggatgaagcggatgcgatggcagcgattgattttatgcaagccgacgtgacggatcgggtggatattcaaccggctacggatgccatggtaactgcattggaagctaaccaactgacgattcatgatttcaacaagggcaatattaaagcgcgccaacgcatgatcgtgcaatatgggattgccggtgaaatgcacggtgctgtcgtgggaaccgaccatgcagccgaagctgttactggtttttataccaagtacggtgacggtggtgcggatattgtgccactatggcgattgaacaagcgtcaaggtaaacaaatgctggccgctttagatgcgcccaagcatttgtatgacaaagtcccgaccgctgacttggaagaagatcggccagcattacctgatgaagtcgcgttaggtgttcgttacgacgacatcgacgattacttggaaggccggacggtcagcgatgctgcggccgaaaagattgaggcgtggtacttaaagactgcccacaaacgccacgcggccatcactgtgtttgatgatttttggaaataagctagttagctgataatcgatcaggattacggctaacctaattaaaaaggcgacttgaagattattcagcttcaggtcgcctttttgcatagtcacataattttatggtgactaccgtaatattggtgggattggtggaaaagcggtagaatggtttaaaatatgtaaacgcttaatgtgagaatatccaagtgctgtggcgaatgcagaggtagccaaagcgattattttgctagacagctcccatggaatctggtattcttacgatacaatcataagggagtaactagcagaaatattctgcggcaatatcgtcagcaagaagccaatccggtattgtcttaaatagtgagacttatgtatgttcacacaattttgcgtgcatacatgagtctcattttctatctggagatcagttagggagtggggctcggatgccagaaaaggagcttacgatgagtacaaaaccaaagtatcaacaagcgttatccgccgtttatgaggaactaggcactgatgaacacggcttacagcaaagtgctgcgtcgcaacggttagaacaatatgggccgaatgcgttgaatcagcaaaaaacgacttccttgttgcaaaaatttattgcgcagttcaaggatttcatgattatcgtcctgttagtggccgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcctggggatgttgtgtcgctagaagccgggaatatcgttcccgcggatttacgattaattgagagtgcgtcattgaaggttgaagaatcggcgctgacgggtgaatctgtcccagttgagaagcaggcggagatgattgccgatggggaattaccaatcggggaccggttaaacatggcgtacatgaatagtaacgtgacgtatggtcgggccactgggattgtggtggcgactgggatgcagactgaagtaggtcgaattgccggcatgattgaagcggccgatgagacgaccacaccactgcaagcgaacttgacacagttaggtaagtcgctgacgattttaatcttagttattgccgcagtggtatttggtatcggaatgttgcgcggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttgttcgtcaaccaggaactggtggacgcgcgcgctactgaattgccgcttgatagccatttagcgcaagtgatgattttaagtaatgatacaaagatcatgccggatgggttagcaggtgacccaacggaaacagcgttgattcaatataatttggatcagggttatccagtcaatcagttgttgacggaccgtccccgagtgacagaagtcccctttgattcggaacgtaaattgatgtcgacggtgcaccccttagaagatggtcgcttcttagtagccgtcaagggggctcctgatgaattacttaaacgggtcactcagattgaaagtaacggtgacgttcagccgttaaccaagacaagccgtgaccaaattctaactgttaatcatgaattggcaacgcaagccttacgggtcttagcatttgcttataaagtgatcaccacggttccgacgactgttaatacggagacgttagaaaatgacctggtctttgccgggatggtcggcatgattgatccggaacggccagaagttgagcaagccgttgcagaagctaaatcagctggaattcggccgttgatgatcacgggtgaccaccgtgataccgccgaagcaattgccgtccgtcttggtatcattaatgctggcgaagatgacgctgtgattactggtgccgagttagatgcaatgagtgatgcggaattcggcaaaaaggtcggcgattactcggtgtatgcccgggtggcgcctgaacacaaagttcgaatcgtgaacgcatggcaaaaacgaggcaaagttgttgctatgactggtgatggggtcaacgatgcgcccgctttgaaggctgctgatatcggtattggtatgggaatcactgggacggaagtctccaagggggctagtgacatggtcttggctgatgataacttcgccacgatcgtggttgctgtcgaggaaggccgaaaagtgttcgccaatattcaaaaagcgattcagtacctcttgtcagcgaacttaggggaagtcttaaccctgttcgtgatgacgatgttgggctggcaaatcttagcaccagtgcatatcttatggatcaacctagtgaccgacaccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagctgttccacgcgtttaattccaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataacccacccattaggggtaaaataaggctaactaatttaaagaaaagagtttgtacatgaaaaaagcaacgattcaaacgtatatgccagtactgtctaaagttatcgaaagtactgaaaaaatgggggaagaattaaacccatcttttgaaaaactacgtcaggccattgataatgacgcagttgccaaaatggttccagctgaattcaatgatattcagatggaatttagcgatggtactgaacagtatcaacaaaatttggcacagttgaaaaaagttgcggtacccgcacggttaatggggcggcatcgtaatttgttagcagcatacgaagcctacacgaatgcgtgtgcggccatgacggctagcatgaacatcgacgatcaaacgattgatgtggctgcttttaatcaggctgaaacggatcaagagactgaaatgggccgcgtttcaaataacgtgcaacggatcatgaatacagtcatgtaggagcgctaatctgggtgattggatttagcacactaataaaacgctcggtaacgtttatgcgttgccgagcgttttattgttggttgcggggcagccaactgtgcggccgcgccgtgctcgtttagcctaatgggctggttttttccagctcacaaccaatgtgtgaacagtatcggtaatggcttcgattggtagtgacagtcaacgacaattttcagatggtcattcggcgcggaaaccggagtaaaacgcgtataatataacgtaatgagattaaaagattgggtgaaataatggataatcagattttaacgttagttgatcaaacgctgacgaagtttaaaccgcaacagatcaaagcggttctcggactcatggacgaaggcaacaccgttccgtttatcgcacggtatcgaaaggaacgtaccggtaacttagatgaagttgaaattcgcgaaattaaagataactatgatcggcttgcgagtctagagagtcgtaaggcagatgtgatgaagttgatcgctgaacaagatcatttgacgccggctttaaagcaagccattgaaaaagctgacaagttgcaagatgtcgaagatttgtacttaccgtacaaacagaagcgacgtacgaaggcaacgattgcgaaagatgctggactggagccgttagcagcttggttattacgttttccggcaagtggtattcaggaacacgcggcgcagtttgtgaacgaagcgcaggacatcacagacgcgaataccgcgttagctggagctcacgaaatcttggctgaggcctttggtgataatgccggtttacgaaattgggtccggaattatacgcgtgaccggggcttgctagtcgcaaaagtgaaacccaagggtaaagcagccgatgaacaaggtgtttaccaacagtattatgattttaatagtcccatcaagcagatggtaccgtaccgggtactggctatcaaccgtggggaagccgaaaaagtattgaaagtcagcattgatgttgatcgtgctggaattgaccggtattgtcattttcgctttattggtcagcaccacggcccagcgattgaactagtagaagctgcttatcaggatgcctacaaacgctttattggcccagccatcgaacgtgaacttcgcaacgaattgagtgcggctgccaatgaacaggccatcaaagtctttggcgataatttgtaccacttattaatgcaggcaccattaaaaggtcgcgtggtattagggttcgatcctgcttaccggacggggtgtaaattagccgtgatggacgcgaatggtaagttcttagataaacttgtgatttatccacacaaaccagctccaactgccaaacgggaagctgctgcgggtgagtttaaaacctttttagagaagtatcatgttgaaatgattgcgattggtaacgggacggcttcccgcgaatccgaggagtttgtggcacaggtattgaagactatgacccgaccggtttattatgtcatcgttaacgaagccggggcttccgtgtactctgctagtgctaaggcgcgtgctgaatttcctgagctacacgttgaacaacgtagtgcgatcagtatcggccggcgactacaagacccactggcagaattgatcaaaatcgatccgaagtcagtgggagtggggcaataccagcacgatgtgccccagaaggaattgacaacgcagctggatacggtgattgagaccgcggttaaccaagttggagtcaatttgaataccgctagttcggagctattgacgcatatttcggggctatccagcacgattgcccaaaatgtgattacttatcgggatgaaaatggcgagttcacgagccgaccacaattgaaaaaagtgccgcggttgggaccgaaagcttatgaacaagcggtcggcttcctgcgaatcattgacggcaagaatgtttttgataacacggatattcatccagaaagttatcccgcagccaaagcgttattggcagcggctggattgaagacgacggacgttgggacgactaaagcccaacagttgaatcaattagatttaacgcaacttgcgaccagcaccggtgtcggtgaactgaccttaaaggatattattagtagtttgcaaaagcccgggcgtgatgttcgtgatacgatgcccgcaccgttactccggcaagacgttttaaagatgagtgatctaaaaccagggatgcagttgcaaggaaccgtacgcaacgtggtcgactttggggcgtttgtggatattggtgtcaagcaagatggcctcgtacatgtctccaaactaacggataagttcttgaaagatccgcgtcaggcggtggcagttggcgacatcgtaacggtgtgggtcgaagaagttgatgaacagcggcagcgcattgctttgacgatgattgcaccggctgaagcataatgactgatttagagttacagcagctcgttgcgaccatttccatgcgtgattttcaccgtccgttccagcaccgcgcttattttaatgctcggttacgaacgacgggtggtcgttatcagttggcctcgcatgatattgatatcaatccgaagatgctgactgattttgatgaggccaccttgattggcgtcatcaagcatgaattgtgccattatcatttacatttgactaagcggggatatcggcatcgtgatgcagactttaaacgattactcgcgcaagtgggtggctcgcgctatgcaccagcgccgaagcaggcgacggcccggccgtatcggtatatttatgaatgccaacggtgtggccagcggtattaccgcaagcgccgcatggacactcgccgctatacgtgtggttgttgtcaggggccaattaaattagtctgaaaaggtttgctaaagtggtacgcttccgatagaattagcttaactattgatatggagggattaagatggaaacgattaaaattggtgtggtcggactaggcacagtcgggaccggcgttgtaaaaatgcttcaagcgcatcaggaaaagatttcagaaattaccggtcgtaagttggaactagcctgcgtagttgtccacaacttgaaaaagcacgaacaagttgatttgggggacgttcagatgaccgaccaaatcgcgaccctgcttgatgatccgtccattcaaattatggttgaagtgatgggttcaattcatccggcgaaggaatatattacgcaagccttgcaagctggcaaacacgtggtgacggccaataaggacttgattgcgcaatatggccgggagttggttcagattgctcgtgaaaatcatcgtgacctgttctatgaagctagtgttgctggtgggattccaattttacggacgattgataatagtttcgccgctgaccggattcaacgggtcatgggaatcgtcaacgggaccactaattacatcatgacgcagatgctgactaagcattggtcgtatgatcaagccttgagctcagcacaagacttggggtttgccgaaagtgatcccactaatgatgtcgaaggccttgatgcggcgttcaagatgattattttaacgcagtttgcctttgggatgagtctttccctcgaccacgttcaagttcagggaattacgaaaatcagcccagaggatattgcggaagctcaccagcttgggtatacgattaaattactcgggattgcggaagaaattgacgatcgcattgcggtatcagtcgggcctgtgctcgtttctgatcaacatccacttgccacggtacaaaatgagaataatgctgtaatggtaacgggaacggctgtggggaacacgatgttttacggtcctggcgctggagaactcccgaccgccaacagtgtgctgagtgatattacaacggttgcgaaaaatattgcgttgaatacgactggtaacacgtttaactcttatcgccaggagacagtcttagcaacgcctgaagatgttgtgtatcctcactttattgccttgaagatgcgtgatgtgccggggatgatgatgaaattgacggcgattatgacccgcgcagaagtttcatttagtcgaatcattcaaaatcaattaggtgacggcaacgctcgtgttgtgatcattacccatgccatgaatgatcaacagttagcagatatcactcgtgaaatcggtgaacaagagaatatgcaactattagcgagttataaagttttaaagaatgcgtaggtgaggacatgttaacgatttcggttccggcgacttccgctaatcttggtcccggttttgattcaatcggtctggcgctagacatgcaattaacgctacaagtgttgcaacctagtgaccattggcagattgaccatccctttggggcggatgtgccgacggatgaacgcaacttaattattaaaacggcgttgcatttggtaccagatttacaaccacagcatttacagatggcttcaaaaatcccgttagcgcgcggattgggtagtagctcgacggccatcgtagccggcttagtgctggcaaacgaattgaccggcgcaacgcgctcttctgctgagctactggaagttgccactcaactggagggtcatccagataacgttgcaccagccctattaggaggcttggttgtggcgacgaacactgatgaacgcgtccgtgcggtgaagttaccgttaccgatgctttttgcaagtgtctacgtgcctaacgaaccgctattgacgaccgccagtcgccaagccttgccaactgaattggcgtaccaccaagccgttactggtagtagtgtggcgaatacgttagtggctgctctagcaactcaaaattgggacgtggcgttaccgctgctagaacaggaccagttccatgaacagtatcgggctaagttagtgccggcactacaaacggttagagaccatgcccacgctctgggattaacggggacttatttgagtggtgctgggccgacggtgattactctgggtgattacggtcaactcgctacgttgcaggcacaattgagccaagatacaacactcaccggccaattattcctattgccaatggatgcaactggtgtaaaagtacaaaaatcttaaaataagcttgtcagactcgcaaaattttgttatgatattttttgtgagttgtgatgcggccatggcggaattggcagacgcgcaagattaaggatcttgtcggggttaacccggtggaagttcgaatcttcttggccgcattttatatacagaatagccgatattgatacgagaaatcgttgatatatcggcttttcttttatacatgatagtgaataatacggaatagaacggaacaaaagcgatactattttgacaaaagcgataccagaaacgatactaaattttgattattgagccagtattttactcatatcgtagacctgtgcagacagttcctgttgggataaatgagcataaatattgagcgtaattttaatatcactgtgacccatttgcatttgtagtgctttgacgttgatattatttgcaacttgaattgatgcgaacgtatggcgcaacccgtgaactgtaattgtgggtaagtctgtttcacctatcaaggcttcgagccaatgattaggtgtcatcactgacatgatttggcctttctggttggtaaagataagatctttagcacgcgggatgactactaacgacttgcgatactttttaagtcggtcgattgttgagctatccagtgagagtgtgcggtaggcatttctagttttgggtgttgatattatctgatggttatcaattgaacgagagatagttttactgattgttaccagcccattcttcaaatcaatatccgaccatgttaacgcaagtgcttcacctttccgcatacctgtggtagcaagtaaataaaacagtgcactacggtcataccgtggttgtgttctgtgtccgtcggtagcatcaacaactgatagaaatgtagccagttgctcagcagtccaaaaattatcagctgctttatcctttgaatagtcaacggaaacttttggaacgtcaactaatttcattgggttattagtaataacacccattttttgagctgtccggaaaactagtgctgcatattgggctagcttattgaattgcttaacgctctcacgccactttaaagcttcttcttggcactttttccatgtaatcgtattaatcctcatgccaccgaaagaaggcgttatatggtgcttaaagatgccctcaacgcgattcaaagtactttcttttacgcctagcttgtaagtctttagccatacttcgtaaacttcatcgaaagtaggattatccataatagcagccggattgtttttacgatgatcaaattcaactttggcgcgatcaaatgctaacttagcagccttactactactaaaacccccatggtgataggttttagttttggtgttaccgttaatatcagtatactttccaaggtagccacgaacgtcatacacgcgtttgctaccaatcattttatgtgtaattttcattttattttttcctccatattgactatgcgaggggccaaattattggaaaaaatattgcacgcaacaccacctttcagtaaaatagagtatgtaaaaggagtacataactaatgtattctgacgcaagcacattccaaactttggacggttgggggatgtgcttttttctgcttatagatcgttattagcgaatgcatctcttaaaagaattaatgccaacaaagcaatccatattaagggagaatggaaatgatagtaaaaaacagcaaatataattccaataacgcctacgatcattatcagccacgagactaggcttgaagtgtaatgtttctggtcaagcgaaggattacttttaatagctggtttatatagagtaaaatgggctattaatgaaaatataaagataactggtaatgtccatagtgaatcttcaaagattgattttggatatgattcctccaatgccaacactatgaaaaatgggtaaaaatcaatattattcacaagagcatatttccaattgaaattcatcgatctaaccatctccaacaattgttaagttttatattaaaaaatctaaatgcgagcggcaggagttggacctgcatagtactccaagaaagaatgggcttcaagacttggaacattgttctaccgttgaactacgctcgcatgttaacagaagtttcaatagatgttgtaaaaagttgtgtacataccaaacaatcccacgatgatggcaactattaatttgagggttattataaacatgttgtaggggttgttatgatttgtttgcagaagtgtatccacaactaagtaaagagatagtactatcaatccccaatctaatagttttgtgatatcaatattcataggtgcctccataattatttgctattaacgtacaacgcgagcggcaggagtcgaacctgcatattagcctaagaaagaatgggcttcaagacttgggctttattctaccgttgaactatgctcgcataatccatatccccaactttggtcggttgaggggatatggttctttaattacttagatgtaatagttagaccggttacgactatcatgaataaagttatttgttgaagttgattgtagtttgattatcaatggcatagtaattcccactatcttcgattagttcagcagagacaaacttatactgattcattttcttgatgtcctcttttccagcaatagcctgtataagcccagtcttttttgtgcctggttgaatcttatcgctgaccaattcatctattgctccgtgattagatgaaagctggttacctgatggggtgattaattcaactccgtttgaagaaacacgctttttactattatttttaagagagtatcccagttgatattcatagtaagtattgttaagttttttgccaaaattattttcatcattagcacgttgtgatttcttcgttgtttcaatttttaataatttggcttctttaaaataataagtagccgatttggtgtttattgccttattatgataatttttaatagctaacagtgtaatttttccagtttcactatcttttgtgtatgttccaactttttttaatggccccgatactttctgtgagtgggacgagcttttattagaattgtttccacaaccagctagaccgattccgataaataaaactgcccctagtgtcgctatctttttaacattcatttacatatcctccaatgatataataatatttgtaaatcaatatcattggttacgacgtctcactgtttgcggcagtggggcgctttttttatttagaacattaattcgtagaatttatctggtagaccataggccatttgtatttcattaaagctttgtggtcggtcgccatactgttctttgtatagggcggtaagttcactacatgcaaataaattagcttcacgttccattttgccttcccaattatttccaatggtgtagagagcggcgcaggacgtgtgatctaatccatgcttcaattcgtgagccatgaccacatatttttctggtacttcttgcaattcatctgacaagccaatgtacacagcaccgctgcttgcggtcgtacatatccctttgaggttgcctaaactagcatattcaacacgataacctaaactgtctgcaatgacaaaaggatcgaaagttcctaatttatcggctaattgatgaacttgtagatacagtttataactgttcatcaataacacctactttttattatcgtcattccgatgcttttgtttatcttcccagaacacaccttccaagaaggcacgtaccttaatttttgtttcgtcgtccatatccatgccttggaaacccattggtacatttgactgtaaccatttatccaggtcgattttatcgtcttcagttgcccagtcaggactgctctggacttcattgcctaaaaggtaatccacagacacgttgaaataattagcaaccttctgaaccttgtctattccaggtgattttttcttccaggtataaaagtagttttcaccgaacccaagttcagtagcgacctgttttaaactttttccatgggattttgataattcttttactcgatcaaacattgatgtatcaaccatcctttacaacggatgaataataaattatcctaaagtctaattttgtgtttgacaaaattatactatcgggttatattaatatccgtaagctaattcaataactaaacaggctatagaaaagagtaccaattaatcctagttttaagcgttccccaacgattaactagtgttaaacggctatataatggcttctttaactatgatttgattgtactctatagtgtacaaaatgacaagcaaattatcataaacactctattggttatcaaattggcttacatacataaatgaaaggaggtgaattaaatgccgacaacattagcagggcgagaacttatcaagaagtatattgatgatcgtgaaattagcattacaagcttggccgctacatttggtgtaggaaagatgtacatgacgcaagtattggccggaaccaagaagtctgctgcggcgaacgagctagttttgaagattatcgagacttttaaaattcgaccgaacgacaacgattagttaggaggtaaatagatgagattaccgcgatggttagtaaatttgtttctaaagaaaaatggatacgtgaaatgccctaattgtaggagttacacgtatccaggtaattattgtgagcaatgtggtactaaactccccagatagattttttgactgtttcagatgcgacgtcaacaaggatatcgcgtagtccctgagcaactactgtaccggttttagctgcataaatcttaaatttagtgctagctaattttgttttaggggtatcggacagcaagtcaggaatggattcttgaaagtccttaacttcatcactacttaactcggagtaactaattaagtcctgtgctgacttgatagccgactcagtccaagggtaagggttaccacaattctgacagtatttgggtacggacttagtagataaaccaagaactacgattccttcaccactaggatcatagttaccaactattggaaaatcacattttgggcatttactaataagtttatccccacattcctcacaaaatccattaggactagttccccaagtaaaagaagctgttctttggtggccgtttaaacatactacttgtgaatactgcttgctcaaatttatcacctcgattgtattggaataatcaaattatacattattcatttattagaaagaaggtaaattaaatgactgaaaaattagttctaagaaaacaacatcttaatggcaataatggaaccaagccaattttcgttgatgtctcaattcttgattctattcgtgaaatcaaagaagaaaccggaatcccaatgagaagaattgttgaacagtttctatgttatgcaatgaagaatgttcagattgttgatgaggaggaaggtgatcagtaatggatggtgtcacattgaatttaccaagtgagtccttagcaccaatcaagcaagaacttactcgtctaattacggatgtgttcaagcaaatagttcaacgcgaagccttaccttattggatgaagaaacaggaggctcagatttacatgaatgttagtgacaagactttagataagttcattgtcgacgggctaaaagtttccattattgacggaactcagcggatttctaagaagtctgctgatgagtattacgaagatcatgaattataaatagtctatgcgaggggccatttattggaggtaattaataatgattgaagtagcactgattacatgggcgctaacagcattatggtttaagcggcatgaaattattagctggtttggaatttaaaggaggaatatttatgtataacgaatcagaaattgaaacggcactggcttatcgtaactactatattgccgcaaaagcatatcaggaagcagaacaagagctgttaaccactattaagtttacaaccgttcgtgaagtttctacggcaggcaataagaaatatcgaccagcctttcttaattctttgagcagccacgggatttattatcgaacgccggctaatagcaaggatggtaagtggtactttacactaccagacgccaaggaggttactgatgaagatttatcctcataagccgtttgaagaatggcaaacaaaacaaaatcccagtaaccgggtgcaaccagttactgggacaaggttaaaaaataaccagataattttacaagtttatggtacaccacagtcgaacctatggcaacaactgaaagggatatttactcatgaataattacaaaacacaagcaaagcattggtatcgaaagctaatgaagacgccagttgggtatgtatgtttagctacttatcggttcaagcaatggcaactttacaagcacttggcacggcaatcagcaatggatcatttgcgaggtgaagaccatgcgtacattcaaccagaaaacaattagtccaggaatggcttactgtgagtgtcttggatatcggtacttctatgaagactcaactcagtttctagcatggttaatgggtgtgctaagccctgaagcggtattagataaaattggtgttcaagaaaaggtgcgtgaataaatatgaaattcagatatacagaagaagttttaaacagttcaaattggatagatggtaatggtgaggttcattgtccggaagaaatgtcaaatgaatatctacacagcgttttgcgatacatctatcggtcacgtgaccggtattggttgaactgccggcaaattaatgtcatcgaaaattttgtgaatggtgatgagtttttccataaggttattcgtacttcaactctttggaaaactattattaaccagcttaaaaccgaaaaaattggttttaattttgattgggaaactggtagtcaagaaacgtgcgagtactagctatgattccaggatatgatgaatggctaaaacctccggaagatgatgaccggcctactaaggaagaattaattgaattaggtgtgattggagacgatgaagaatgaacttatatgaaatggcgaccaactatcgcgacttaaccaaccgtgatgatctgaaaccagacaccattgctgatacgctcgatgcgttaactgactcgatgaacgtgaaagtcgataacattgcaagctggatagatgagaatgcggcagatattgatttcttggacaagcgaatgaaatcactacgggaggaaaagcaacggttgaaaagccttaatgatcggctgaaccattatctagcggacacgcttgatcaagccgaaattaagaaattaaccacggaccaacacttggtttcagtccgaaactaccgtgcgtccacggtggtgagtgaaccggataaacttactgctgactatgttaaagaagttcatgaataccagccagacaaaacggcaatctacaaagcattatcagctggcaagaacgtgcccggtgctcatctggaaccgaatcggaaggcagttattaaatgacgaccgtttggaaggacataccagggtatgagggcatttatcaggcatctatttatggctatgtcagaagcgtaaatcggattgtttacaaagggcgaaatcataccccgtcacaagttaaggggaaaatcataactccatggttagaccacagtggttatttaaaggttgatctatatcgatatggtaagagacggtgcgaaaaggtacaccaaatgattgctaaaacattcatacctaatcctcagtgcaaagaaacaattaaccataaagatgaaaatccattgaacaatacagttctgaatcttgaatggatgacgaacaaagaaaatgtgaattacggtactcgggttcaacgtgtaaaggaaaaatatggataccacattattaggattgcacctaatggaatgattgacgatttttttacactacacgaggctgaaaaacgaacagggataccacggcaaagtatagcctatgccattaagcataaaacaaaactaaaaggttatatttgggaattcttcgggaggtgatcagggatgtttcaactacgtgactaccagcaggagtcggtcgatgcggtctacgattcaaccattcatggacacaaatccatcgtagtacagtccccgccctagaactgggaaaacggtaattatggctgatattgcacgcagggcaacagctaaaggtaaccaggtattatttatcgttcaccgccgagaaatcctggaacaagccgagagtacgtttaaacaagacgacgttaacatgtcactttgcaagatgggcatggttcagaccattacccggcacgttgatgagttaaccaaaccagccatcatcatgattgatgaagctcatcatgcactgtcgaagtcctaccaaagaataattcaagcgttccctgacgcgcttaaattgctgttcactgcgacaccgtggcggatggacggcaaaggactagacgtgattgctgacgatattgtgctaggcaaacctatcagccagctaattgaccaaggatttctagcaccagttgattattacgcgccgtccgaaattgacgtgccccaacttaagaccaaacgcaacggtgaatttgatgaagctagtattgatcaggcggttaagccgaaaatctacggcaacgcagtccggcattacttgaagctggcaccggggaagcaagctattgcttacgcctataacgtggcgagcgccgaacgactggcggatgcgttcaaccaagctgggataactgctcgggcagtatcgggtaagacagatagggcgactcgaaagcggattgtatctgattatcgtgctggcaagattcaagtggtcactaacgccgaattgtttacagagggcttagacttgccgaacgtcgactgtgtaatcatgctacgcccaacgcagtcgctatcactttatttacagtttgccatgcggtcaatgaatccacgagtaggtaaacgggctattattattgatcacgttaacaacgttgagcgattcggtttaccaaccatcgaccgaaactggattttaagcggacgtgataagcattcgaaaagtagtaacggtagcccgattaaatcagtttcggtttgtccggagtgcttcgcgacgttttatcgcaaaggtgagacctgtccgttttgtggcgcggagctgggcgaagaaaaaattattgagaccgacgaatctatcaagctcaaaaagattgaagctaacaagcggttggcattagccaaagagattgcagagaacaatgctgctaacgcagtagccgataagtcgccgagtgagttaaccacgtacgcggagattaaggcatacgcaaaactgcacgaatataagcccggttgggcatacttccaagccaagatgaaaggattgattagaaagtgagttggcagttaattccgaacactggcggtaattattttgttaacgagaagaggcaaattttaagcaagtgcaggaagaaaaccagagttttagttccgttcaagaacgataagggatattcatatgttgcaatttgtggtcgtcgaatagcagtgcatcgcattgtagcgagtgcttttgtgaataatgatgatccacttaataaagtacaagtgaaccatttaaactttgataggtctgataacagagctgaaaacctggagtgggtcagccatcgagaaaatttaaggtattctgctgttcgggggcatatgtcagttaaaaaagtcgttaataaaagcggatttaaaaatgtctactatgcgaaagaaaaaggaatgttccgagtcgttgtcacctatctaggcttgaagaagcatattggatactttcgcaagctatcggatgctgttcaagcacgggacacatattggcaacacatattaaaagaaaaggaagtgatctgatgtcaattctaccaaagaatgaaccccataagcccgctggaacccctcgtaacttctttatttggggccaaacaatgagcggtaagagttacctagctgaacatttcccaaatgtattagttttgaatactgatggaaatagcgccatgggaacacgaccaagcattcagctaagaaatgtccgcaaccctgacggtagtttgaagagtagtgtcattgatcagttacaagaagtaattttggagttaggaactacccaaaacacgtacgagacggtgacactagatgttatcgatgatgtttgccagctgattgaacaggcaatttgcctgaaagcgggggtcgaatcgttagcagacatggggtatggccgaggatatgcattgttcaatactgtgcttcaaagtctggtaatggatctcaaggcattaccaatcaacgtcgtttacattagtcgtgagaatgactttacagatgatgatggtaataccaagacagttccgtcactcaaaactaagtattacaacgtggtcaacgggaattgtgacttggttatccatactcaacacgttggcaagaactatttacgaaacgtgacagaaattcgtcgccggtataaagccagtgaaattaatgattcaaagattctcagtattctgaaagctattccgaatgcattagcgccggaagtacaaacaacgaaagtaggtaaataaatatgagtttattagatattgcagcaaacactttagataactttgatccaaagaatgattcagttaacgcaggtagtacagggttaccagatggagactacctaaccgctgtggaaagcatcgaacatcgatcattcgattcaggttgggattgcttacaggtcgtgttcacggttttagacggtgaccacgctggcgaaaaagagtacgaccgcattagttttgccactaagagcaaagctggtaaggcgattccagattttattcttagccggagcattaagttcgttatcaagctaggttcgttattgggcgtggagatgaaaccagaatactttgccagtgagaatgaaactgacacacacgaaatgttagctaatgtacttgcgccagaaaaaggtaagtcggtgattctacacattaagcaccgtccaaacaagaaggatcccgacaatccctacgttgaatatgacctagacgcaactgaacagcctgaaactgcagacatcacggatgcagacttacctggcgacttaggtggtgcaccactgccaactgacgcagacgcaccagtagaaccaacagatgaattaccgttctaaataaatactgcagtgccaataaaccatcgttcgggtgtgatgcccgttaatttacagaaggaggccggccatgcgtaatttagttaattatgcagttaggtacgccaaggccggtttcagcgtcctgccaatgattggtaagaaaccgctgattaagttcgctgaccagcccgccttgaccgttgatcagatccaaagctactggcggtcacacccgtacgctcaattagcactacggacaactaattttttcgtgattgatatcgatgaacatcccggcggtgcggatggttttaaatcgttcaaagactatgagcacccagagtatttccgtgaaacgttatcgcagaagacagcgggcggcggccggcaactattttatctaaagcgtgaagatagcactgtgcagcagaatatcggatggctaccgggaattgatattaaggctcacgttaacaattatgtgatggtcgcacccagtgagcggaatggtaaggcgtatcaatgggagaatcacaatccaatcgtgacggccccacgtgaactggttcaagcaattaatgcgaaccgtgacgatactgtcgacgtgttcacagacctgaacattgattacaccgagaagtcaggaacagccacgttgtttgaaaccattgtcgacggtttgggtgccaccggtggccgtaataatgcattggcaagttttgccggcggattgttattccggggtgttgatccgcgagcagttatccagctaggcttactggcaaatgcaaatacagacgattcactgactcagcgagaagccaagacaacaattgaatcgatgattaaaaaagaaattagacgaagggaggctaaccagtgagcgcagaggaagaagcggacaagctccgcaagttagaggaacagcagaaagttgtaccgttgaaaaatcgaattaattttatggaaacggctaagggcggtattaaagcaaattcacttgaaaatgtttgtctgatattagaacacgatccactgcttaaaggcaagttcgcgtataacgaatttagttacgaaactgagttcatggaagattcagccgagctaatgttggaacatggaccactgcaagatgagttcacaccagcagtacaacggtacatcgaacgtaagtataaagtcatgtttacgccaaagttaattgatgcggcagttaccgaagtgtcacgacgtaacgtattcaatccagttattaattatctgaacgaatgttacaaaaaatgggacggtgttactagggtggctgacttcttgccggtttatctcggcgttgaaaaatcaccagtgacaacattacagaccaagctattctttgtcggcgcagtagccaaagtattcaagccagaaactaaatttgattttgttttggatttagtgggtggtcaaggaactggtaagacgaccttgcttaagcgtatgtcaaatggctggtataccgaccaattcactgactttgaaaacaaagacaactatggcaatatgatgcgggcttggatcgtgaacgacgatgaaatgaccgccaccagccatagtagttttgaaatcttaaagaaatttatcagtgctgaaattctggagtaccgaccggcctatggtcgctataccgtccggcgatacaaaaacttcgtcatggcccgaacgaccaatgaagtgacttatctgaaggataaaaccggtgagcggcgttttatgccggtgatggtcaattcagcgctacagaagaagtcaccgattactgacttgccgcagggaacgattgatcagttatggggtgagttcgccagctactatcgcgacggttttcgattcggattaacgcaggatcaggagcagatgatggcagacaatcgtgagcaattcatgtacattgacgccgaagaagatgctatcgaacaatcactagctcaaatcaagggtgatttcgttacgagttccgagattgcattcaagatgggtgttccggatattgttaaaaatcgaaaattagccaataaaattaagtacgtcatggacaataaaaaggaatggcacgcgacacaacgacggattaagggtgttccgaaacgtggatactcgcgagtgaagtcagagtagtcatagtgtagcaagtatagagactacgcctgggccctacggccccaacgtatacattaatatgtatactctacttatatatatatttatatatatatattattttatatagggtatagggaataggggtacacgacggtgtgtgttggaaaagttgaaaacaagtgactacatgactacacctccgttaactcattggggcataagggataagacgtattcggttagttgaagtgtagtcactaattgaggtgacacaatgcgagaacaagaaatacaaaatcaaatccgcgtggcggtatctaaaaataaatgttcaatttttcgtgcgaacgtgggaaaagttaaaaccgaagatggtcgctggttcgatgtaggattaccgcaaggctttccggatttatttgggtttcgtcattcggatggcaagatattctttattgaatgtaaaaatgaaactgggcggcaacgggatgatcagataaaatttcataattttttgacaaaacaacacatgattcacgggattgcacgtagtccggaagatgcattgaagattattaatgagggactggttggatatgggtttaagtgaggtaaaaaaatgaaaataattagtttagaaagcattgggttaagtgactgtctacaagatgaagatacctttcaaaattattggacgatacggcagtttagagtgggacacaaatacgacgatgattccagctcaacaataatcagcattgacacaagcatcaatgggaataattacattattctaacagaagatggccataaattcgtcttgccgggcggtcaatatatcgctgaatatgtggaggacgaagatgcctaaacacactaagaagcggtcaacgactaaacggaagcaccggcaaatgaaggagcacgccgaagcaaacaaagctaaagcacaggatagtaagcaattggccaatgaatatgagccgtacaacattaataagcgggcgtttgaagtgttcggggaggattgaaaatgatcattaaaattaacaatgattatcaggtagaagctcaaaaatataacaattgggtgctacaacgggttacagatagtaaaggtggacgattaacggatagtgttggtaagcccacaccgaaagcaatccaaatcttacaatagagcatgtattttgacaataataaataatgccacatgatgattgcaggtgaaatttatacgatagctagaatgagggtgaggaaatataatggaaaaacgtatagatcatgagaagctcaacagcctggtatgtgaggttgaagatcgtcatgcgaatggcattcttgatgcgagtgttaaagagatggcacctatttggaagataaccaaggctacaatgaagagtggttatttagcagtatcattgcgacaatacaatttaattgaagcatacgcaaccaaaagctcgcatacaacagaggagaagaaccaaaccttaaagcaactgcataagaaatacagttggctaaatcggcgggtgacggagtaccgacacggcaatttaattattcgaagttgaggtgggaagcggtgggtgattttgaaactaacaagaagttcttaaggcgttaccgaccttactttagacaaattaaacggcttgaaactaagctgtttgtcattgatgatcgtattgagtcaacgcattcacctagtatgactggacaaccaggtggtggtaagcggcgagagctagctgacgatttaattcagcgagaagagattgaagggcggattaaccggttaatcaagaagagtcggccaatcaaagctgaaataacggattgtctggatgaactaactaattcgttagaagcttctatattagagcagtattttattgaagatattcagctggacacgattgcattacagatgagttattcgttccgtcaggtcaaacgactatatggtgatggggttaagcacgctaagatacctaaaaactgtgacactctatgaaccatgtcccctgaatgtcccctagatgtcactaaaatgtcccctgaatgtcacttacatgccgagtaaatgggtgtatatttgtattatcgaatagttccaaagaaaagtcgtcacgattgtgtggcggcttttctgttatgatgttaagtaattaatattttggaggaactattcatgagcaaatcagaagttattcagaatttattggacgagttgaataaccagaaccaaatatatattgcaattattggaactatccttgcagttcttgggcttgcttttactatattttcattcatgcaacgacgattttctgataagcaaatacaaaaaatggaagatgattttaagaaggattttgagattgaagagcgtaaagtagattttcaagagttaactgaggctgttcatggaactttagacatagtttctagagttaccaatgagcttgaaaaatcaacaaaagttgaaaaagaattgcaaaaacaaatagtttcagcgatgaatagtaatttagaatcaaaggccagcttgttggaagctatatcagtgttgtctgatttatcaataattaataatcgtttagaaggattgaataacactttagcagatgtgaaagatagagtggtaccaaaaacattggatacggtattggttttaactactaatggtatgatgagaataaaagagaatattactaaacgcgatgtaaagctgactgataaggccattgagtacatgaattcaatagaacatcagttcaatgaagtagttgagaataccttaaaaacagatactgatcctaaactcaaaaatagtattaaagttgcaaaccaagatctgataacaaaaattagtaatgtaattagttaataaacaagcgccatgccaaacggtgtggcgctttcttatacacaaaaatattggaggtaatacgaatggaacaatcagagttcaatacaacgcaagcaatcaatgagacttgctatggcttagtcaaacaaggttattcattgcacgatatctatagtggcttgggcaatgttatgaatgggattgagcctaagcatcttaccaagcaagagctggtcattgatctgaatgttgacacatccaaggtaacttgtaagttacgtcatgcactggacaaatgaacaatgccacgcattctatggttcggttgagtgggaacatctgcgcgctgctatccttaaacgtgaccactacgaatgtgtgtggtgtaggcgtgatggtaaggtcacacggtatggcgatgttgatagccatggtcgtccagttgtattggaagttgaccacatcaaagagttggctgactatccggaattgcgaaccgagccgactaacctacggacactgtgcaaggactgtcacaacaaacgacatcatcggatgaactatcgaagcaagcatgagcgtaaagagaatcggtggagcaaggacgagaggtgggattaatggtggaacataatataacttggtcaataaacaacgggcaaaagatacctgagatctatgttgacggtgagcaggctcaggtagtgtcgtgtagttatcagtttgtaacggctacagatattgatgagtcaggagttagcatgatgactgcaaccatcatcttattatcggagtgcgactataagccaattcaccatgtgatctttatcaatcaacagactggcaaggtgttctatcaatagataaggagtgatgactaatggatagattgcgatgcttactactgcatcatgattacatttatgttggcatcatgcgtgttaatggtgaacgattccactgttataaatgtaaacgatgtggcaaacagaaggtggtatagactaatgcgatcaagaaccgataacactaagcaagttgtggtctacgtagtcatgcgtgaccaacaagcaaatgtattatttgcacatcgtgtttattttagtgaacggcgagcaaagaactattgtaaacggatgaataatgcaaaagaatttactggctattactacattaataaagcaatcttttttgactggaaagcatttatttctaaatttacagaggcccccggggtcaaaaaaattggcgaaaaatagaaaactgggaaccggtgggtaggactcgactccggaaaaatattgctttttttaatcattcaggaaggggggtgggggtttggaccaccgtaaaataagaagggaattgatgcagcgaatcgacaaaaaatcagctgttgagaaagagaaggttgaccgatatatcagtcttttggacgctttttatcagcttgatgaaagcatacaacagcatggcgtgatggtcaaaatcgagaatggtaaacagatatactggaaaacaaatccagctgtttccgaaaaaaatcgtattaattccgcgctaataacgcttgaaaaggactttaaacccgttaaagccacccctaaagtgtctaacacagccactactagcgatgaaaagggtggtttggtatgattcgacagaagtatgttgaaagttacctacaggcctataaagacggctctatcagattgaataaacggcgaataaaactcgtggaattaatagaaaagaccgttctaactaacgaaaattattattttgatgaagaaaaaattgaggactgtttaacgttcgctgataagtggtttttcccatttacaccctgggagaagttcttaaccgcgttcgtttttttatatgatcacaccactgagcggcgagcaattcggaagttcatggtagtcgttggacgtggggctggtaagaacggctgggtatcggtgatttcatcttttcttttatcacgactgcatggagtccgcaattataatggttccattatcgccaatagtgaagaacaggccaaaacatcagttgatgagattcacgatgcggtcgacttgcatagtgagttgaaaggcgaattttatgcgactaattcgcaagttcattcgaagtcaaccaactcgacgttacgataccggacttctaacgggaatactaaagatggcttgcgtgatggtttcgttattttcgatgaaattcacgcctatcagaataaccaaaatgtaaaagtccatatctcaggacttgggaaagttcgagactcacgagttttcgagattgggtccaaaggctacgtgcgcgatggctacttagacaaagaactagcgaaagctgatgcaattttaaacggtaaggcccccattgaatcgatgtttccatttgtttgcgagttggacaacttgaaagagatggacgacccagccaactgggagcttgctaacccatcattttctaagccgatgaatggttacgccaaagacgtttaccaggagactatggacgactataacgacttggaactagacccgtccggttatgatgagttcgttattaagcgcatgaactaccaggttgaagacctggaaaagtcggttgccccttatgagcaaatcaaagcgactaaccgtccgattctactggacgacttgcaaggcatggaagcgattggatcggtggattttgcatctattcgcgactttaccgcagacgggttgaccatcaaacgagaaggcaagcagtactttatcagccatcagtttgtccgccgtcaatttgtcgataagttctatgcgtattcagctaaaccacaagaccgcccccagtctgctcctcctattgctgaatgggaagaacgcgggttactgactgtggtagacacgccaacaattgacccgcaagcggtagttgactggttcttggaacagcgaaagcgttttatcattaagaaagttgtcatggataactttcgtgccgatcttttgcgtaagtttttcgtagacgctggatttgaagtcgttgtcattcggaatccaactgccattgatggtttgctggcccccaggattgagacagggtttgccaatcatcaatatatctggggtgacaacccgttattgcgatggaacacacagaacgtgctggtttcgaccgatagccacggtaacaaacgatacggcaagaaagaagaaattcggcgaaaaactgatggcttcaaagcgtttgaatatggccaatatctggttgaccaattacccgactactcggtaaatgaatcgctagatatgttggcagacattgatttctaacggaaaggaggtgaatatatgagtgtaattaatagcttctttgacctatttacgcggcggaaagattccagctttatttatgatcttgatttgttccaggacattaagaaccgagcctacttaaagcgtatggcgattgacaccgtgatcaattacgtgggccgggcagttagccagtcggagtttcgtgtgatgaacaaggggttacctgttaaggatgcgatgtattacaagctcaatgtccgaccaaatactgacgaatcggccagtgatttttggcagcattttatttaccaattgatttattacaacgaggtgctggtgattcaagacgacgatggtgatttattaattgctgatgattttagtcgtcacgaatatgcagtatatgaagatgttttcgacaatgtcacggtcaaagaatacacgtttaagcgttccttcccgatgtctgatgttatttacctgagatactccaatgaccagctagaacactatctgactggtttgtggggagactatggcgagttgtttgggcggatgtatgagctagaattgcgtaataatcagattcgcgcgactgttaaggctgatatgacggctggtgttaatgacgataaagcgaacaaactgcagaagtttattgacaagattttccaatctttcagcaagaattctgttgcactagtaccaatcacaaatggctttgaatataacgaagtatcgaacggggtaggcaaaaatcagacgtttgatgaaagtaacggcgtgttactggcattcattgaccatgttgcccggctggtaggagtgccaccagcgttaattcatggtgaaactgctgaaagtggtgaaaatcagaaactgttcaataagcagtgcttgagttcgttattaaataagattcagtcagagcttaacgctaagtcattcagccagcgagattacttgaaaaatggaaaacaagttgaagttattggcattaatcgaccaacactaattgaactagcagaacaaatcgacaagcttggttcgtcaggtatggttactcaaaatgaggttcggtcagcagttgggttgccaccacgtgaagacggtgaccagatagtgatgaccaagaattatacaatgaaaggtggtgagaataatgaagaagattaacgttaagggtccgattattagtaacgatgacaagtggatttatgacatgttggaaatggacagtactgctcctaaggatgtcattgatgcattaccagatgatggctcaactgttgaagttgatattaattctggtggtggtttaatggacgctggaactgaaatttatactgcgttgatggcttatcaaggaaaagttatggttaacattgttgggatggccgcaagttcagcgtcattgatcgccatggctggtaatcccacacggattagtccagtcggccaaattatgattcacaatgtagctggtggattgcgtggtgattaccgtgatcaggctaagttgtctgaaattttaaagcagtccagcgaagcgattgcgaatgcttatcatcttaaaactggcttatcgatggaagatctacaggccaagatggattcagaaacgtatttgaatgcagaccaagctaaagaattaggctttgtcgatgaaattatgtttgatgatcaaattgaactagtcgctgatggcggttcaggtatgttaccgaagtctgcagttgataaaattgctgagttaatgaagcaaacagccgttaaacctagactgtctgattcagatattgaccgaatgtcaactgcagtggctaacaaactatatgctcaacctacaaagcaagcggaaaattcatttaccccgtttgctttttaatttagaaagaaggaaaagtaatgattaaatttgatacaaatgttttcaaaaactttactgacgcacgtgaaaagtacgcacaattggtgaagaacgctgccaagcccgaagaacaacaacagggttttactgatatgatggacgctttgggtgaagatacactttcagaaattaagaaccaagttcacgctcaaaccgaagattacttggacgcccgccgacacgaccccaagatgtcgaacgaagaagtgaagttcttcaatgaaattaagacagacactggatttaaagaacctaagttattgcctgagacggttgttactgaagtgttcgatgacatggttcaagcccacccgttacttcaagctatcggtttgcaaaaccaaggtattagcttgaagattatccaatcagatgcttccggagtaattggctggggtaatattttcggcgaaatcactagtcaattagatgctaagttcaaggagactaaagctgaccaatccaaggcaaccgcgttcttggtattaccaaaggacttaagcgacttcggcccatcatggattaagcaatacgtaatcacccaaattactgaagcctttgcggtcggcgctgaaactgcattcttgactggtgatgggaatcaaaaaccaattggcttaaaccgttctgtcaaggaaggggtggccgtgtctggtggtgtttatccggaaaaggaatccgctgggacgttgacgtttgcagataccaagactgctgctaaagaattagctggtatgatcaagaatctttcaactaaggaaaatggtaagccagttgtggctaagggcaagactgtcatggtcatgggccctggggaatcattagatgtagaagcgcaattcatggttcaaaatttggcgggccaattcgtcactgccttaccatttggattgacgattatcgaatctgaatttgcgcctgaaaacaaggtgattgcattcgttcaaggtcgctatgatgcattccaagccggcccattgaagattcaaccatacgaccaaacgttggcacttgaagacatggatttatatacggcaaagcaattcttctatggcaaggccaaggatgataaagcagctgcggtttacgacttgaagcttgctactcctggtactacgaccactgaaccaacgaccggcggtgacacgggaaaatagcgaccccggacaccggggtaactaagcctaccgcgaacagtaccgtagctgagattacggcttggttagatgctaacggaattgaccacactggagctacgttgaaggccgatttactagcattagtggggtgattaagtgaatccattattagatcgattcaaactgcgtatgaagatttatcacaaagctgaggatgcaaatttatcgcgaattctgaatgcaagccagaagcgtatcaccgatattactggtattgccagtaacgccggtgatgatgtgtatgacgagctagttttagaacgagcacgatacgcttacaatgaccaagtcgagtttttcgacgctaattttttggacgacttattgtctgcgtccttgaccagctatgaaccgggggatgatgaagatgaaccgaccggagtttgagtacaaagcaccaccagtaagaacgaatcagcttaatacgccggttcgcttttttcgtaccgtcaaaaatttggggccagagccggggcgtggtcaaactgaacaagcttttgagtgtttgggtttagcttatgatccatccaccaaagaccgtgaagtgcttaacgttaatgaagcaaagtatggcgtgactatcaagattcgcgatacttttggcgaatttgacccgacaactaaggacaccgtggttattggcgaccgccggtatctggatgccattggtcaaccgattgtttgggacattctccaggtagcaccagatttagaaaataaccagttcgtaaaaattgtgctgggggtgactaaatgacggaagtgacggttaagtttaaaggcgttgatgaagtaattaataagttggccgaaaagtttagcccagcaaaactaaatcgtattgaaaatgatgcgttaagagtagccggcaggcgagtagcggttgaactcaagaatgcggtcgccagctatcgtgacacaggtcaaacagttcttcaagtatcagtcggtaaccctcatagtcggggcggtgtacggacgattaagattggttggcacgcgggatctcgctggcgattagtccatctgaatgagctcggttatacacggttcggcaaaacctatcatccacgcggcatgggtaaagttcaaggtgcatttgatagtagccgtggccctgccaaggcacttgaagaagctgaattgaggcaactactatgaccgaaaccaaggatatgcttgcaactatttataccgcgttgttggcaaatgcaacaattgcaaaactgacattggctggtgatggcagtcatcgaattagttattttgaaagcccagaaacggctgaccacgacaatctatttgttgtgattacacctgtcggaccaccggtaccagcggctgttggcagtgatgattatttgaatgtgcaattcacgtttcaagtcaatgttgaatctatcagtcgaccggcacgtaatgctgtggcacgtgaaattcaaaatgaaatgcttgctttgggcttttcaagattagctggtgctcagaacgaattagatgaattcatgactgaaactaaccgctttgttgatgttcgcagataccgcggtaacactaaattgtatgacacaaattattaaggagagatgtaattatgtttgtaggatataaacgattaaagattcaaccatttgccgaagacggcatgaaaaaaggtgacctgattattgttgaaggtcaggcacacaaaggggctacgaccactgctgaaatcagtggattagctaaagacccagtgaaagtaccagggtctaatatcgattactacttgtcacgtcaaggcttgggtgacgctaaggtagcactcggtattttagatttaccggaagctagtgctgacctattggctggtttccgcgtcgatgatgacaagatcagctatggtggtgaagatacgttgccaccatattgctcaattgaaatggaatccaaagaagacactggtgaaattgcgttagttggtttcttcaagggaacttttacgcgggataagattagcttgagtacgctggattcatctaaatcatttacgccagaagctgatgcctggacttttacgccaattagttcgattgccactgctactaacggcgaagtgatgcagaagtttgtgggcgatgccactaaggatgcaacgactgttacgaagtttgaaaagcaattgtttgatccaaatggtacggcgagtagtaaagattaagagtattacattaacagcagataaaccgtctatttcagtaggtgcaacaagcacaatcacttcaacagtacttcctgataacgctacagacaaaacagttttattatcagttgatgaccctgccgttgcaacgttaacaggaaacacgttgacaggtattagtgctggtgttgtaacagtgattggcactgatgcaacaaagcaagtcacggggacagttaaagtaacgattactagaacagaataaaaacactttaagtcgccgataaatcaacaataccaattggggcggctttttgtgtatggagggaaaagactatgagtacaccactaaagatggaattacttattgatggtaaaaagcagaccttcacggaatcgttcattccggcaggccgtatcttggacgcattggacttaatcgaaaccgataactcagatcgtaaattgcgtgatgtttttgaagaacgagtagcatttctagccaaagtatttactaacccgttagtgacaacagaagcaatttggaatggtttcaatgcgattgattttgatgatcgcacgttcgcaattatttgcaaagtggctggtgtggacccaaaaaagctacagatggcgacgacaccggaataaccatcaaagaagcccgcaaaaaagtattatcagcagtcggcgcaattgttgaaaaccgcactggctatacactgtcgagcgtattaaacgatgttgattttaaattgttgtcgcaaataatcgaagcaacgaccgaacagactcagcagactgaaagtgggacccgagttaaaccgggaactgtgggtgtaaatcctggtaatcagcctgtcatgagtctttttgactttgctagaaaatcttaatgaagggaggaataataaatggcagatgaagtattaggccgcatggtcatcgagttagggctggatcacgctgcgtttggtaaagggttaaccggtgctaaacgtgaagttaagtatgcaatggctgagatgaaatcatcaatggctgtactcggtcaatcgggccgccagtttgatgtcctatcagctaagtctaaaggcttgtcacaagtaatgatgagtcagcagcgggttgttgaaaaactgggtaaagcgtacaaggactcgctggttgatggtaaaccaaccgcgcaaacagctaagctagcaactcaattgcagaatgccaatgctaaattagcctcattacaaactcagtataagaataatgcagcggcaatggctaaagcacgcgttgagcaaactggttttaccggtggcttaaataaagttagcaaggccgctgtagcgactggtacatcgatgaagaacatcggctcaacgatgaccagcaaagttagcgccccaattgcggctggtttagccattgcaactaaatccgctatcacttttgattcgcaaatcaagtccatggggcctctgctgactaatgggggcgcggttaccgctaagtaccggtcacagttggatcagttgggtgatgcatctaaaaagatgtcgatgaagtacggtgtctcgactactgaaatcaacaatggcatggcggaacttattcggcgtggttacacgactaaccaggttctaggctcaatgccgtctatcttagacgctaccatggcttccggtgaagatatgggtacggtcatgaatgccacagcgtcaatcgttgaacagttcgggttaaagactaactcaacggctgggacgatgaagaacactcagcgggttaccgattcgctgacatacgcggccaatgcaactgcggctggcttcggtgatatgtctgatgcgatgagctacgtcgggccggttgcatctagtttgggtctcagcgttgaacaaactgcggcggctgttggtgagcttagtaaccaaggaatcgaaggccaaaaagctgggactaatttacgtggtatgctgactagtttgattaagccaaccaagcaaaacaccgaaggattcaagagtatgggcattagttcgaagcaactggcccatgactcacacgatttaccgcaattaattgatgatatcacacatggcactaagggctggtcaaacgctgaacgtggtaaggccttagcccaagcattcggacgtgagaaccaagctgctgctaacgcattagttaaggccggttctaagagcctgcgtgacttgactaaagatactgaaaacgctggtggtgcgactaagaaagttgccgagcaaatgagcaatacttcggcaaataatgtcaagaaactgattgcgtcattacaagtgctaggaattgaaatcggtgagaagttaattccaaaactaacaccgttagttaagaaagccacggatatggttcaaggtttttcaaagatggatgatgccactcagaataccattattaagtttgccctattagctgctgctggtggcccagtattgagtatgctgggtaatatcgtcggtggatttggaacatttggtggcggtattgttaaagttattagcgctaccgcacaatggcacgcgaagaatcaagcagctaaagaatcactcgcgatgttaaaaggtgcgactgatgccactagtggcggtttcaaagcgttcaagggtagtgttgatactgtaaatggctcagcatcaacggctaagtcaacatttggcttgcttaaaggtgcgtttacgacggccgaagctggcgccggtgtattaggaacctcattaagtgtgacgggtgcggcagtgaccggcgttggtttggcagctgtagccggtgtggcttactggcaactctacggtaaggaagcggcagctagtgccgcacgaacacggcagtggggttcagatgtcggtgaacaggctgattctgcactgactaaatttaaaggatttagcactagcgcgggtacgtctttgactgactttgaaacagctagtcaaactagcacgaagaatgttgctaaagacttcagtgatatgtatacggagatggagaaggattccaaagacactatccagcagatgcagaaggatatgaagggcctacccgactctgttcaagatgacttaaaagaagatatcgctgatcgcaagaagcataatgctacagtattggccgatgctaaggaaaattacaataacgcggaagctatactcaagaaccacaacggtaagatgtctggcttgagtgatacagaacgaactgcattactcaacagccaacgtaaaatgaatagcgatgaaattagcctactaaaaattggtggaagtgctaagaagaacgttctagccgcattgaatggggatattggtaacatgacccgtaagcaacgtgatacgaccattaatcaattgacgtcttcaatgcagaaagaaaacaagctttacaatgatcagagccagcagatcaagtccatgtacgataaaggtgaaatttctgcttctcaatatggcaaagcaatgaaagatttacaagcgactcatcgttcaacaacggataatatggctgcagcaatttataagttggacaaggcgaatgggacttctaaagctcaaattacgcaggatttactaaatgttggctacacttacaagcaagcagcggcgattgtaaaacggcaaaatgatgacatgagtaagagtacatccttggtggttgctgaaactggcaatatgagtaagaagtctaaggcggcagccaatgcctggaatagcttagtatttgattccaagactggaaaagttaagaccaatgcacagggcgaagtcaataaagccgctaaatctaaggacaaatggaaccagatgaagctactggttaaacaaggaaagatgagctccaatgccgcggccatggttggggttgcggctgttcagaccaaacgctgggatggtttaacgcttaaagagaaacaggcgatgattaagtctaaaggtggcgatgatctagccgggttaatcgaaaagggcaaacaatggggcaagtttaccccagccgaaaagaaggccatcattacttccaaaggcggaccagaactcttaggcgtcatgactaaggctcaaacttggaataagttaacgatggctgagaagcgggcagtcttaaaggacaacgcgtcgccagccatgaaacaagcttcggttagtgtcaaggactggaataacttaacgccacaaatgaagacggtcatggctaaagctaagggtgccgaagatgttgctaaaggcgttaaaaaccttaaggattggaatagcttaccagaacgtgaaaaacggttaattgcaaacgacaagggcgctacgggaattattaagaaggtaactggtaattataaggcttatcagaatttaccaaaaaacgctactaagaatttatttgctaaggataatgctagcaagaatgctggtaaagctaaaatttcagttgacaaatatggccgggttaaagtaactggtaaggtacttaaggctactgataaggcgtctggtcctgccaagagcggtaaaaagggactagataaatttaattcaaccaaaatgcagactaaaactgcaaaaggtaaggattcggcctcaggttcaatgaacggtgcacgtaaatcggcaatgaaatataacggcgttaatatggcactcaaaactgctcgtggacatgacgctgcatctagtccaattaacggtgctcaccggtcacttgatcgatacaacggggtgggcatgcgtggaaaaaccgctcgcggatatgattcagcaagcggtgctatgggacgcgctaaaggttcgttaggtcgctacaatggaaccggtatgcgagacaagactgctcgtggtcacgatggcgcttctggtccaatcagtagtgcaatccgtactctaagccactggaatgccatggggaacgtgactcacttcattacaactgtttttcgtaaaattactcggcacgccacaggtacaacaggtaccgatggtaatccaatcattgttaatgacgaagaaagttcagtataccgtgaagctgtcaagtatcccgggcatccagcgtttattccacacggacgtaatatctatctgaatgcaccaaaaggaacgcaagttattccagcgggattaacggccaaaatgtttggtgtctcacagtatgctgctggtactattccggctaattcatcaattatccaagcttcgaaagccatcaatgactcaattggcggagataataccacaatcaactataacttgggtggtagcgacagtacacaagcaatcgtagcgggtctggaagctatcctgaataaacttgatgaccaacaaccaacatttgaagtgcataacgatatgattggtgacaagctacggactttgattaaacaaaaggattcacgggaacacaatttaaatcgattcttcccacaaggaggttagcaaatggatgctttaattacaaacttaaatggaactgaacataagttgagtgacttcggcttccaagtgctcaacttcgaagaatcggcgccaacaatcaccagaactactaagagttttgatgggcgcgccggttcattggattatggaggccggcatgtcgttaagaggattacaatcaatggtttgtattgggttaaaatcctggaacaagtggatgatgtgcgagataaagttaacgcggctttgtcacaagcggaacccatttatttaacacgcatttacggtggtcgaaacttgtatgacgtgcgtgagagtggcaaagactttgtgatgccagcacaaactgttgataagaaacggtttaaagtgtatcgaacagataccaacttaccatcaatcatcgagcggactggtaagggcgtttactacacctggtcactggaatttgagacagtcgaattgccatatggtgagagcaagccacgttcgcaaacattagttagtggccaatcaataacttataacggtacagtagcttgttcacagctagaacaggctttttattttgttgtgacggctaaggtggcgtctgctggtgggtttacgttgacagtcgatggtcaatcattgatagttactagcccagtagtagctggtgacgtttatacgttatcgggcatgaataatactcgtggcagtcagaacattaatgataaaactaatgcggggtattttatcctgcatcctggtgcggctaacaaggtagtatgttcaatcagtgcggatgtcaaaattaaaaatttgtgtgatttatatatttaggaaggtgaggtgaaaattattgattaaatttcatgatccggctgggacgccccatttcggccaagctaccattacaagaactactagcgttaatggcggactgtcactgactggtgaagtgtttgccggcgatgacgtattgaacggtttagattacggctggtggctgaatttcgataacgaaaagtatgtcattacgtataagaagttaagcgacgataccaatacaatcgttttcgatgcggtgcaacagttcttttgggatttttccaaagtagcattgcattcacagtatactggcagtcatccgtatacgttctatttagaacagctattcaatggatctgggtataactacaaaaatgatgctaccgtaccagcgtttgaaaaagaaaactggggttatagaaacaaattaagcttattcaatgacattatggatcaagctaatgttgaatttgaagtgcacaacgaaacagttcacattgctaaacaaattggcagtgacctaaccagtttcgttcgtaagggaattaaccttagtgatcttactgaagaaatgaaaatatccgattttgcgacgtatgctaaaggatatggtgctttcaaaaatcaacaagatccaagccaaggccgattagaagttgaatatcgcagtgaactagctaataaatttggcgatttagaaatggatccgattgtcgatgaacgatacacggttgcagacaacctgattgctgctttaaaaaagcaggtggatgcgacttataccgtgtcaatgaatatgaacatctacgatttagaaaatgctggttaccctaattatgaatcgcctaaagttggggactggattctagcgattgatgaagcgttaaatttcaaacgcaaggttcgcatcattaagctcgaagaacagttcgatgtgaccggtaagcgtatcggatatacggccacttgtggtgatctaagtattgtagatcaatatactaatctacaaagtagtttggatagcaagatacaacgtattcaagaaagcatcgacagtgtagccaccagtgctaatggcaaaaatacaaactattatggtgcaaaagaacccgtgaatgccaatgaaggtgacttgtggttcgatcaaagtaacagcgattcagacaagtggtctatcaagcaatggctaaacgggcgttgggaacagattacattgaacccaggcgagataagcgacaaagtcgtggctgttagggcagaagctgaaaccgcaactaataatgccaaaagtgcatcagacaaagccgaccagcttgcgtcaaagtatgatgatacgaattcactagctagccaagcgttcaatctagcaacaagtgctcaaaatgatgctagttctgcggtttcacaggcgtcttctgccgctgcagattcaaaagatgctaagcaaattgctggagcagttagccagagttataagacgttaacagatggttcaactatgaccattgctgaattgcagaatggcttagctgccaaactgactaagaatgatcttaatggctatgccactcagacgtgggctcaaaatcagattaaaatgactgctgaaggaattaatggcaccatgtcaagtatcaagagtactgttgacagtcaaactaccagtattaatgaccttaaggctgattctagtgggtttaaagctcagtttacgactgttaataatactattggtaagcacaccactgatattggtgcactacaagcgtctactaagtctttatctgctagctttgattctttgaatactgacaataacactaataagcacgatattagtcaacttcagtcaactgctaaatctttcagtagcactttgatgactgttcagcaacaagttactgatgggctagtatcaactaatatctttagaagtgcaaatgacctttcacgttcttattggactgatcctttaggttatacttttactactttgcaaagtgagagtatgtaccacgattcattgattcactatcaaggtcagggcaagacacccgcaccatattcgactattgctcagcaaacaatcgctgatggtgttatggctgctgatacatggtacacgcttagcttctatgcacgtggagctggagacaataatgcagtaggaaaatttgctgtgtacttttatgataatggtagcgaccagtctatgtctagcagtgatggcgttgaagtgctggggacatcagatactcattgcataatttcattagtaccgtacttcagacgttacgtaattactttccacacccctaaagatttctcaggcgagcattcattctgggctagaaatgacctagatctaaacgatggcagtttgtactgtgatttttggcaccctaaattggaactaggtaaagttgcaagtgatttctcggtaaatccagcagatacagcaactatttcagcattgtcaagtatttcgcaaactgtcgatgcaattcaaacaacagttcgtggaaaagtggacgatagcacgtatcaatcaaagataactcagattgatggtgcaattattgctaaggtgtcaaagggggatattactaatgaaaatatcctgccatattctgggtactggtctgatacgacaggatggacgctattcccctggggtgcttctgacaaaacattgagtctggttcatcataacttctaccacaattccgccgacgcgactttgtgcatacaaacaactcaaaacgctatggccctggcaggttcctcaaggtttacgcttgttccaaatactacgtatacttttagcttctggggatttgcatcaggtaatgttattggatctaacgtatacgtactcggcaaaagttatgaatcaacaaatgaatacgattttattcacccattattcgaaaatcttaaaatgtctcctgctgggattaacaagtacacggcaacctttaaaacaggtccgactgagaatacggcttatgtacggcttgacaatggtggatctaataacggccagagttccggttcatatttcgctgaactcaagctagaacaaggtgatatagctacaccatatactagggtttcaagttcagaatttcaaatgacttccgaaaatatcaatcttaaggtttccaaagatggtattgtgaacgcaattaatatgtcgcctgaaggaacccagatatacggtaacaaactgcgcattacagctgctacctatattgataatgcagtcattaaggatgccatgatctccaacctaagtgctgataaaattacggcaggtactatcaatgctgcgaaggtaaatgtaatcaatttgaatgcgaataatataacagctggtacgattagaggtactaacttaacgattggtctgaatagtggtgatgttgagttccaggcggggcacatccattcggctgataatgcaattgatattaacattaataataagtatatttcagtagctaacaatagtaatcgtgtaatgttaaaaaatggcgaaatgcaattcgttgagccaagtatgttcgatgtcgaagattctccttattttagaatccataatcgtggaggatatgcgtatggtggtgcagaaatggtcggacgagattatgttgcagtgtctaacgctgcaaattctgacgactattctacgtatcctattggagttgaagatttttcaggattatttacaggatatgatagagtagctaaagcatggcgaccaactaaacttgctggtgccgaacggggtgtagtaatctccggagggtcgacatttcaaagcaaatttatgtccgcttctcctcatattatagttggttatgataacacatcaaaattagctggtggtaatcggatattgtttgatgcggaatacgttcatagtttttcaacatataaaaaaacaactagccaagctcccaatgtctatgtagctcaagatggggcattattgcgttctacttcggcttctaaatacaaaacaaatattgttcgtggacattctgttgattatggaaagaaactcattcagttaccaacagcaacgtggattgataaggcaagtttgaagcgttacaacgaagatccgtcacaaccagtaccgagccttaattatggcatgattgccgaagatttggccgctgctgggctcgaatatctcgtagtccgaaatgacgaaggtgaacttgaaggtatacagtatgatcgcattgcggttgccttgctgccattactttctgagtggaagcaaattattgacaaccaagaaaaagaaatcaacgaattaaagaaggagcaataataatgaaaaatactattgaatttatgaactcagagattacaggattggctaatattttaggagaatttaagcttaaaggtaaggccagtttgggtcgtactgtattgattcgcaaattttctaaaaagcaggaagaaatcaacgatgatctggttgatattcaaaagaaatattttgaaactaacgaagatggctcattacgagtattaaaagatagcgaaggcaagctaattcctaagtcagaattggcggataaagatgaccctaagaaattaggggcaaaagctgcaaaagaattggacgatgaaatcaaagatcttaacaacgaagtttctattatcgattttagtgaatattcgcctcgatttaaggcactcaaggctgctttagaagattacccatatgagcttgaaagtgattcagcaattgcatatgaacgagtttacgaccaattagaacaggcattcagtaaaggagaaaaataatatggacttaattaatcgtagtattcaatacactttatcagctgaaactggtaacactaataatgtcgttgtcgggatttatggaaaatctgataatcttgaaattaatgctaacttgacaattgtcgcagatgatttagttgaaggaactaattttgatgatctttccaagaagcaactatttgcgttagctactaagaagctacctgatttgttgccaaatttgacatacactaactatcaattctttgttcaaaacgatgtgccagttcgattaaccgcgtactcaaatttaagcaataatggcagctatattacattaaattcaactctcgaccagtccgatttcacagataaaactatcggatcaatcggttatgaagatgtaaaatctgcagttcaaactattcttaatcaagagttccaagcatcgtcaacggaagcgtgatgtgatgtttgaacatttagcaaaaaatagattttggttttggaaagcgatggaaacatatgggttaggaatttactttattattaagcacaacacatttgcatttgagccacaacagccaatgctgcttgatgtgttggatgatccacctatgatttttatgttggcggtggttggaacgtttgctctggtgtattctttgtggaatttgcgtacgcattattacaagccgttaatgaccggactgcttacgtttgtctggttattttttatgattgcctttggcgttcatgattttgaaacgcaacgttatgtgagttttgaaagtatgtatgccatgtttgttttaggatcaaccatttttgaaattgtaattggggatgattaagggtgagcgatgctgttatcgtggccttaattaccacagcgggttcaattttcgttgcggtcttaacgatgtggaacagtaacaaggccgctaacagcgatactgaaaccaagttaaaaaaggaaaatgaggctttaaaaagggaaaataatgagaagcaagaaataattgactattatagaaagcgtgataaataatgatggaattaatccaatttattaacggtaccacgattgcggcaatcgccgtagtaacatatttagttgtttgggcgattaaacaaactcaattcagtaacaaatatttaccaattattgcccttggcgttggtgcagtgattggtatttttattggcattgccaatggtgatatcaaatgggtagctggtttggttgatggtgtgattgcaggtgccgtcagcgtcggtggtaatgagctagctaaatcgattgggacaatgcttaatggaggtgcaaaataatgagcttaaatgggtttgatgtagccagctatcaggctggtatgaatgtaggcaaagttgcaggcgactttgtgttggtgaaagcaacagagggtattgattatactaacccagaatttaatggacacgcaaagcagactttgccagcaggcaagaagctaggcgtgtaccattttattcgaaacgattcagatattaagcagcaggctgattacttcttgacggttgttaagccatatattggtaaagcaatgctggttcttgattttgaaaacacgacaggttcaaccattcagaaccaagcaggtgtcggcttagctaagcaatggcttgattacgtgtatcaacaaactggtgtccgatcagtgctttatacggggattagttgtgagaactcattagattggtcatccgtagtcaaggccaactatgggttatggattgctcagtataacaactacaacgtcgtgaatggctatcaaccacgagatttatatggtagtttgaagcattggaagaccgcggtaatgttccaatatacaagcactggacggttaccgggctggaatggcacccttgacttcgatgtgttttacggtgacaagtccgcctgggataagtacgctaaggcaactaaaatggttacaaacaaatcaattgttcgaaagaccacaaccaaagacggtgtgtggacaatcaccaatgaggttgggacgtttagaccaagccaaaaacttggtattttcaaatatcctggcctagaattaactggtaagtattacgataaaggtgaatctgttaagtattttggctatgtaagtaatccgcaggctggttacatctatatcgcttatcgatacaacagcaagctaatttattatgttgcttgtcgagaaattgccaccggtcgggcactgggtacattcgaataaatactagattcccgcactggtctttgttgactggtacgggaatttttgtgttttgaatctaattgttttaagctatgtaaacttggcccctcacaagagcgatactaaaagcgatactaagaaaactaaatgttgcttaaatgctgtggtaccaatggttttgctagctttgctatgaaatcttcttggccgcactaacgaatataagaatcgatttcgataggttaagccttgaaggatcgattcttttttttgttgcggtaaattggactggtcacgttatttcaggcttgcttttttgccaactacttcaactatgttcaccaaatttgccgtaccttattgtttaatctcatgattaccagcattataatgaaaacggttaatctactgattacgatattaagagaaggcgaggaccaggcattgattagaatgagtagatggtggtggcgtatcttggtgggcggagtgcttgttagtggcgtggtttaccccgcacaagcggccgtaacgacttatccgattacagggattcaggtggtgcagacgcgggtctatcagacgaatagtcagaacggtgtcggttaccatttaaccgtcgtgcgtcatcagcgtgcccaattgcgtgttaatttacatttaaagtatcaccagcatacacagtggacgcgtactgagcaagctgatatttatcgcaacgggcattaccagcgcttctactacgtgcataatggtcatcagcagagcggctggatagctgctaatcagctaaaacccgccagtacggcgtcggttcaactgcgggtaccactgattgaccagctaccggagttgccaacggggtgtgagatgacagcgactaccatgatgctgcagtatgccggtgttaatattaataaggaacagtttgccagccacgtgccgcgcagttcgaatcctaacactggttttgttggtgatcctgcttcggcttacggtattggtctctacatctacccccaaggcttgttaccaacgatccgccactatctgccgtccgctgtagatctcagcggggtgggcctgcaacgacttaaagcacagctcactaaacgtcatccggtagtcgcttgtgttcagggactcgatggttttgcgagtcatacagtgacgctcactggatatacaacggcaactattaggtacaatgatccttggcgtggtcaatccggacagatggataaccaagcgtttgagacgatgtggcaattaaatggtcgtcgggcactgagctattaagaaattgataccatagttaacattagttactgtttcataattttatattaaaaatacgctatttgacacacaaaataatcgtttttaatactgtatcacactagtgtatcaacttctagcctgaaataagggcttttagctttagtgtattttggcacggaatttgcatatatataagtgagtgcgaaaaagattgcgcttacagtatcaaaaacataaatagttacaggcaatttagatattatttattcgttttatatgactgtaacgaaaaaataggaggtacaaagatggtaagcattatcattgctagtcacggcgaattcgctaaaggcatctatcaatctggatcaatgattttcggcgaacaagaaaacgttcaagccgttacgttgatgcctagcgaaggccctgacgacatcaaggctaagttagaaaaagccattgcttcattcgacgatcaagagcaagtcttattcttagtcgacctttggggcggtacaccattcaatcaagttaacggcttgtttgaagcacacaaggacaaatgggcaatcgttgccggtttgaacttgccaatgttaattgaagcgtatgcttcacgactttcaatggattcggcacacgaaattgccacgcatatcattgaaactgctaaggctggggtaaaggttcgtcctgaagcattagcacctaaggaagaaaaggctgctgccgctgcaacgaccaacaataacgctggccggccagggaagttggaatatgggttagcacggattgactcgcgactcttgcatggacaagttgctactgcttggagtaagacagttaacccaactcggatcattgttgcgtctgataacgttgctaaagacgagctgcggactaacatgatcaagcaagcagcgccatctggtgtcaaagcgcacgttattccaattgctcaaatgattaagattgctaaagacgacaagcactttggtggtcaaaaggcgttggtcttattcgaaacaccacaagatgcattacgtgcaatcgagggtggtgtgccaattaagacattgaacattggttcgatggctcattcggctggtaaagttcaaccaaacaaggttttggcatttgatcaagatgatatcgacacttaccgtaaacttgaaaaagacggcatcgaatttgatgttcggaaggttccaagtgatggtaaagaaaatatggataacattttgaacaaagctgaaaatatgttgaaggaacaaaagtagttccaagaatatcagaaaagatggaggattaaatcatgaatttgaacgtaattcaagtgattttagtcgtacttgtatcatttttagctggtatggaaggtattttggatgaattccacttccatcaaccagttgttgcatgtaccctaatcggattagtaaccggacaattagtcccatgtattatcttaggtgggagtttacaaatgattgccttaggttgggccaacattggtgccgccgttgcacctgatgctgcgttagcatcaattgcatctgcaattattttagttttaggtggtcaaggccgtgccggagttacttcagctattgcgattgccgttcctttagccgttgctgggttactcttaacgatcatcgctcgtacgttagcaactgggattgtccacatcatggaccgtgccgctgaagaaggtagttttagtaaaattgacttctggcaatgggttgcgatctgcatgcaaggacttcgtattgcgattccagccgctttgattttggccgttggtgctacgccagtgaaggcaatgttaaacgctatgcctagctggttaactgatggtttatcaatcggtggtggtatggttgttgccgttggttatgcaatggttatcaacatgatggcttctcgtgaagtttggccattcttcgctttaggttttgttttagctgcaatcagtgaaattactttgattggtttaggtgcaattggtatttccttagccttaatgtacttggcactttcaaagcaaggtaactctggcaatggtggtggctccaacacgggtgatccggttggcgacattatcgacaagtattagagaaggaggcaaactgagatgtctgaaactacaaatattactaaaaaagttacattaagtaaaagtgatcgtctgcatgtttggtggcgttcaacgttcctccaaggttcatggaactacgaacgtatgcaaaacggtggttgggcttattctttaattccagcaatcaagaaattatatacaactaaagaagaccgtgctgctgctttgaagcggcatctagaattcttcaacactcatccatacgtggcttcaccagttattggtgttaccttagcgcttgaagaagaacgtgccaatggggcacctattgatgacgttacgattcaaggggttaaagttggtatgatgggacctttagccggtgttggggacccagtgttctggtacacggttaagcctatcgttggtgccttagctgcatcattggctatttctggtagcattgttggaccaatcttatacttcgttgtttggaatgcaattcggatgggcttcatgtggtatacccaagaattcggttacaaagccggttctaagattactgatgacttatctggtggtattttgcaagatattacccgtggtgcttccatgttagggatgtttatcttagcggcgttaattgaacggtgggttaaggtggacttcagtccagttaaagtttcgaccattaagcaacaagctggttcgtacattgactgggataaactgcccaagggtgcttctggtgttaaggaagccttaacacagcaagctgctggtcgttcacttgacaaatacaaggtaaccaccttacaagataacttggatcaattgattcctggtttgatggcgttgctgttaaccttcctctgcatgtggttattaaagaagaaagtttcaccaatcattattattcttggcctcttcgtattgggggttctgttgcacgttattggttggatgtaatacttgcttatgtcatatttaaaggatggactcgtgggagctcatcctttttatttacaggcgtactttgcataactgacaaactcgccgtataatcggtatgaggatggatacgaggagggattaatatggtgcaatcaatcaatactaaggttgatttagttacgaacggcaattcacatatggggttgaccgattacggtaaaatcatggtcggtgataacggctttgaattttatgatgatcgcaatgttcgtaactttattcaaatcccttggactgaagtgaaatatgtggtcgtatccgtaatgtttggtggccgttggattccgcggttctcttttcaaacgaaacggaacggtatgattactttctcagctaaggaccctaagaaggtgctacgagccgttcggcaatatattgagcctgatcgaattgtaaaatcactgacatttttccaagtccttgggagaatattcaagggtaaaggtaaaaaagataagtatttgaaataatgaccaatgctgtcgagggttctttgccgacggattggtgattatttaatagttagtttaagaagcttaagtatcaacgggtggggttagcgcgggttgatacttaagctttttttaacgcatcaaaagcagtatccgagcacgttaaggtgcgtcataaatggaattttaataccatgaaacagaaatagttgtactgacaagtcttaaaaagtaactgattcgggaactatggtagaatatagtgtgttatagtgtatcaaaacggatcagctatttgatagtggtgaaaaggagtggcgaagttgaccagaaaatccaagatttgtgaatacgtccgtcaacatagcgatcgacacggactgacgacggaaatggtagcgaccgctttaatgatagcgcgttcaaacgtcagcaaggaattaaatgcactggtacgagaaggccagctgcacaagctgacagggcggcctgtgcactatgttccggtgaatgcgacagccacaacggccacaacaactagtggcgtagcgaatggggcgacggcagagcgaataccgacagcgcccgtcgcgacgtctgtgcctaaaccggttgtaaatgatatatttgccagcatgattggttcgcatgagagccttgctaatcaagtggaacaggcgaaagcggccattctttacccaccgcggggattgaatacattaatcattggcccgactggttctggtaaaacttactttgcaaacgccatgtatcgttttgcggaaacccaacaagtcttaacgaacccgcaaggcctgattacattcaattgtgccgattatgcgcataatccggaattattgatgtcgcatttgtttggttatgttaaggggtcttttacaggtgctaatgaagataaggacggtttgatccaagaagcggatgggggcatgttgttcctagatgaagtgcaccgtctaccaccagaaggtcaggaaatgattttttatttcatggatcacgggacttattcacgactcggtgagacggcgaagagtcaccatgccaatgtccgcttagtctgtgcaacgaccgaggacccagaaagtaccctactgcagacctttgttcggcgaattccgattacgattcagctaccagcgttcaatcatcgctcagccaaggaacgtttagaattactgaaggcattattgtcattggaagctaatcgaatcaataaacagattcggttaacggaggacgtggtgcaggccttacttggctcagtcacatttgggaacgtcggtcagttgaagtcgaacattcagctggtgtgtgcccagggttttgtcaatagcatcgaaaatgacagtgaaatcacaatcacgatggatgatttgccacagaatatccgtagcggtctcatgacagtagcctctaaccgtcacgaactgggggccatctctgagttgttggacccggttctcatcgtgaagccaaatgatggcccaacaccgcttcgtaataagaacgataattatgaattaccatataatttatatgagattattggtgataaagcagcgttactccgacgagaaggccttgataaagaacacatcaatcgtttcatcacgaccgatatcaatgtgcatttgaaatcattttataaacaaaatcagttagaagtttcaccagaaaacaagttagccgagatcgttgatcaggacgtcattgattttaccaagacggcgcagatgacggttcaagacatgctaggttataatttcaaggataactttatttacgctgtgagcttgcacgtcagttcctttatcaaacgcatccaggcaggcaagcccatgcgtcaaatgagttcggatatgttagcgatggtgcgtgaatatccggctgaaatcaaagcagcggaggcgctcaagcaaggattagaggaacggtatcatttaccgattcccaagtccgaagtttattatctggccattttgctcatctcgttaaaatcgatgcagcttaacggcaaagttggcgtgttggtggcagcgcacgggatgagtaccgcgtcttccatggcacaggtcgtcggacaattgttagatgattatgatgttcaggctttcgacatgcctctcgatatggacccgagtgtcgcctatgatcatgtcaagcgacgagtagaaaagcttgattctgggaaaggaattttgttactagtcgatatggggtcgttaacgaccttcggggaacgaattcagcaggagacagaaattgcgacgcgaacgattgacatggtgaccacgccggttgttttggaagccgttcggaaggctagcctggtcgatagtgatctggattctatgtatcaggagctcgttggtttcaaaggttattcgcgaatttcacggaacctaccaacggatagtcagcgcgcaacagtcaagcccgccttagcgacggataagacggcacaacgggcgattattgcaatttgtgcgaccggcgttgggacggctgaacgtatcaagtcaattttagacagtttattagctcaaaactttatcgaaggtattacggtattcccaatctcagtggtcgaaatgaagacacggatacaacaaatcagtcaaaattatcaaatcattgcggcaactgggattacaaaacccgaattagacgtcccttttatttcattggaagaattgctacaaggtggtggcgaaaagtttattgaccagttagcgacggggatcgattcgccacagaccatggcggaagaaagtcagcagttgacaccggaactctgcgaacggtacttaggcgattacttcacgtttttaaatcctaagaagttaacgggaattttatgggagtatagcgaagtgattgcgacgcacttggatggtgtaatgacgaatgcttttcgcattgatttgattatgcacttagcgggtgcgctagaacgaacggccatcaaagatgaaatttcggcacccaccgaagagatgccagacattatggcatcgaagtggtacccacttgtgcaacaggccaatcagcaattgacagatcaactacagttaaccttctcagatgctgaaaattattatattgtgcaattattggagactcatcaggcaaaggtcgcgatgagttgatacactaacttggcatgctttttgcatgtatcttattgagtagatttaaccgactgaggagggaaagtagatgttagcatttgtcgttgtcagtcatgggagttttgcgcagggcgttgtcgattcatcctacatgatctttggcaagcaagataaggtccaaacggttacctttcaactagacgaagaacctaatgaattagctgataaattagctgctgcggttgcccggtttgacgcggatgaccaagtcttattcttggttgatctatggggcggttcgccatttaacgccgctagtcggattgttgccgaacatacagagcgcatgggtctgattaccggtctgaatctgccaatgctgattgaggcttacactgttcgtgataagccaattgatgaggtgattgcccaccttgaagagactggaaagattgggattaagcatctcaagttgttacaggacgatggggaagatgagccgctatgacgatggatattcgtttagcacgcattgatagtcggctactccacgggcaagttgccacggtgtggaccaagacggtcagtcctaaccgtattttggtcgtctcagacgaagttgcccaggatgcacttcgcaagattctaattgtgcaagccgcgccccctggtgtgaaagctaatgtgattacagttgacaaaatgatcgagatttatcaagactcgctatttgatgaagtaaagccactaatcctaactgatacgccccagaacatggcgcgcttagtagcggggggacttgattttagcaaaacgggcattgatattggtagtctagctttttcagcgggcatggtgatggtcaccaatgctattgcaatcggtcaagccgaagcacgggcattatatgcgttacaagcagcgggattaaaggtgtttgcgcagaaagtcccgacggataaacgggttgatgtgatgccgctattagctaaaaatggctttatggcgccagataagtattaacaaagttatgatggacagtggtgtgtcggttatgggcaccactgttctttcattttggctaggtttctaaggatttaccaaaaatacagccgtaaactttgacggataggcttttattgataaaattaaactaatcgaaacggaaagtagcgggggtttaaaaatgccaacttatacaaaattaaccgccatgggacaatatgttccgggacgcgttgttgataatgacgaattagcagccattatggacactagcgacgaatggattcaggcgcatactgggattaaaacccgacattacgcgatgaatgatgaaaacacctcggatttagccacccaggttgcccagcagttactacaaacaagtggtttagctgccagtgccattgatttgatcctagttacgacaattacgcccgatgccttaacacctgcgacggcttgtttagtgcaagctaatattggcgctgataatgcgtttgcgttcgacctgagtgcagcgtgtgctgggttcacgtttggcctagcaacggctgacaagtttattcgcagtgggcaataccaaaatgtgatggtgatcagtgcggaagttaattccaagatgatggactttcaagaccggacggcagccgtcttctttggggacggtgctggtggcgcgttattacaagctactgacaatccagatgaaaacagcttgatcgctgagaaattagaatcgcaaggaaacgctacggtcattcactctggacgagtacggccgattactgaagttgccgcaacgaactacccgcaaacggatgcgttttaccaagttggacgggatgtttttcaatttgccacgacggttgttccagaacagatgcgtgggttaattgcgagtgcgcaactgacacccagtgatttacaatacgtgatctgtcatcaagctaatttacggatcattgaaaaaattgcggctaacttggcgttaccaatgacgaagtttccacataatgttgatcattatggtaatacgtcctcagctggggtggcaatggccttagccaatgtttttgataccttaactgggccagtgttgttaacagcatttggtggcgggctagcgtatggctcagtcttgatcaagaagtaggggtgtgcagatggaattaaaagatttagatcgattagttgagaaatacgcgcgacagggttatcagcaaattcgcgttaaagccggcgacttggagattgaagtgacaaaaccagcgttagcttcagaaacggtaactcccgtagccgctacgcctgccagaacagttgcggagactgaagatgaagtcgttacactgccgagtccgatggtcggggtggtccacttggcaccagatttaaaggttggtcagtcactgacagctggtcaagaactaggccagattgagagtatgaaattattcaatccattagttagtccgaccgatgggacgttaacagcagtactagttgctgacgacgccactgttgagtacgaacaaccgttatttacaatgcgaaaggatcggtagctatgtttcgcaagctgttaatcgcgaatcgcggtgaaattgccgtacggattatcaaagcctgtcaacaattgaatattcagacggtcgccgtttgctcaactgctgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgcgctaaggattttgcacggcaacaagcagttccggtactagcaggtcaatcattacagggcttagcatggccggatattaaacacgcggccgccaagatcggttttccactagttttgaaagccagttatggtggcggtggcaagggtattcgagtgcttaccgacgttcatgaactccatcaacaattgcgggctgcgcgtcaagaagctgctgcgtcctttttgaacgatgcgatgtatttagagcaatttctgacaactgcccgccacattgaagttcaagtcctcggtacggggacgaaattattcattcttggtgatcgtgactgtagcctccaattgcacaagcaaaaggttctcgaagaaagtccggcaagtattttgactgagacacaacgccggaccttatacgatctgtcccggcagttattagcgggtacacattatcaaagcttgggcacaattgaatacttatttgcggatggtcagttctatttcatggaaatgaatacgcgtttacaggttgaacacggggtgacagaattaaccaccggaattgatattgtggctgaacaaatcaaacaggcggctggcgtcacggttgattttccagagcatgttggcttgcagcccaagtgtacggcgatcgaagctcgattgaccgctaccttaccggttaagcagacgcggattgaaacgctgagctggccagccgatgtacgagtggatacggattatcatcagggcgatcggctagtaaccatgtatgatggtttaattgccaagttgatggtcaccggtgcgaaccgtcagcaagccgtgcgcaacttacaacgggccttagcgcaagtaacattgacgggacccacgacgaacttaacttttctacagcaaacggtggcccggccggcctacattcatgatcagtacacgattcacagtctagcacgttgggaggcgtcgaaatgagtcattatccagcttctgggacctggcaagcctgccctaagtgcggtcggcacgtccaccaacgccaatggggcacttatcagcaatgtccttattgtcactattggcaacgactgacgacggcgcaacgattagaacaactcgtcgacgaagggtcgtttcagccgttgacgatgactgagcggcctgtcaatcagctggggttcccggactatacgaacaaactgcggcgggcccaacgccagaccgggttaaacgaggctgttgtctgtggaacggccctgattgagcaacaaccctgtatcttagcagtgatggatagtcattttatgatggggacgttaaacacggcggtcacgcgtcgcttattgcatgctagtgaacaggcgcgggcccaacggctaccactgatcattgtgaccgcctcaggtggtgctcggatgcaagagggtgtttatgccttggtcggaatgaatttgattctggcagaattagcacggttagcagcaacgccgttacccttgatcacagtgctgacagatcccactatggggggcgtatcggcgagttttgcgtttaagggtgacctgattatcgcagaagcgggtgctaagattggctttgccggagcccgggtcatccaacaaactttgcctgtcaagctgccggcggattttcaaacggcggatcagctgtttaaaaatggtatggtggatgcagttgttgaacgacctcaattgcggtcagcgctaggacaagcattagtgaattatgggattgggaggtcagcccatggataaacgattacagcgattacgggcggctgatcggatcagtgcgccgactatcattcaagcgttattgccgacaatgacgcaacaacggggtgaccgcttattaggtcaggatgcggctttaacggcgggctttgggcgcactgccactggtcgccaattagctgttctgggcgttgaccggggtgttgatattgcgagccggcgtcgaaaaaacgggggagcattaactgttcccggctatcgcacggcgttaagagtcgtaatccatgcggctaaatttgggtggccggtcgttagcttaatcaatatgccaggtgctgatgcgagcccccaatcggaacgctatggtcagagtcaggccattgcggacttgattgcggcgactggtcagctgaccgtaccgaacgttgttgtatttctcggtgagggccatagcggtggggcgttagcctttgccaacgccaaccgcattatcatgctagatgatgcacttttcaacgttgcttctcccgaggcagtcaccgcgattttacatgggcaacagaccagcagtgacgccatcgatttattaccaatgacagctaacgctttgcagtcgcgcggcttagttgacctggttattgaccatcaggatcagacattagtcgctgcgatcaaccaggcgattgagacccaacttaccgcactagaagcattgccggcaccggatctaattgaacagcgcgaaacaaagtttcaacactttttacaatcttggccggtcaattaaaaataatcatcaaaaaatgggcttctcagaatttttattctgaagaaacccattttttaatagttgcttagtactgattagttgtggtttgatcttgagtcgtggtctggtcctgcgtcgttgtatcttgtgtcgtactagtgccataagtagtggtatcactagacgttgtggtacttgatgaacttgaactggaacttgagctacccgttgtaattgaagctgtctcagagaagactgactctgttaaattactgtttgagagtcccagcgctttacggatgcgcttcgaattcttgtaacgttctgacgaagaggcaacttgataagagagcccatcgatcgtcgcgtcagtaccttgaacggtatatgatttggcatggtgagacgcattcttgtacttcgtatcgagtgcgaccatgtcattccaagttaagtcggtgcgcatgttcttagcgagttttttcgtaatcttttcaatattggcaattgacccaagtgagttagactgactaaccatggccataataacctgccgttgccgtttttgacgaccataatcaccctgaggatcgtcataacgcatccgtgagtaatcaagtgccgctgcaccattaagtttgatcttaacgcctttcttaacgttggcattaccgtatttgaaagtcagcttaggtgtcacggtcacgccgcccatcgcgttgatgatctgttttaaaccacccatgttcagtaagacgtagaagtcaattggaacatccagtaacttctctactgacttgacggcaccacttgcgcccccaatggtgtaggctgcgttaattttttgtgattgcccatcgatcatcacttgcgtatcccgtggaatactagtgagcgtcatactttcttttttaggattgattgtcgcaacaatcatggtatcagtccgggctgagaagtccttgccgcgacctagtgcaccagtatcagttcccaacagtagaatcgagaatggcttgcccttcttaataacggcatcaacattccgaagcttggtcgagccggtcgactggtaggtcgtattcatcgtatccttagcggcattccaggtcttgtagccccaccagccacccgtaacgatcaacaggacaacgacgattagtaaagtaattaaccaaggacgttttttgtgtggtttcaaatgtgggttacgctgttgctgttcacgatagcggcgttggcgtggtcccatttcattatcattgttattttctgacatattcgttcctcatcactttagatttttccctcaatagtcattttatgacgtttagcaaatcattggtccttaaagttagtaatttaaaaagattttaataatcaaaaaattactggcatcagtagtaacacaattatagaacactataagtaatattgtgaccggcgtcaaacgtttccatctataaattacggtacaagccatcataaaacagtggtatacttgaataattctcattgaattattattttacatagcttgatagcgatattcaatgatgagcaatttgttaagaggggaagactgagcgtgcaaattttacagacattcgtgcagagtattcaaggtgtcatgacgatcatcgtgatgattgcagttggttacttgttggcacgctggggctggtttaatgaaagtgcgactaagctgattgcccgattggtcactcaaattgcgctaccagcctatatgattgcaacgatcacaaagcagtttacagcgcataaattattatcaacgttgccaggattacgttttccagttcttaatatggctattttgtttggcatttcgttcggggtgatgcgagccttaaatattaaaaagagtcatcgcggcttatttgcctccatgtttttgaactccaatacggtgtttattgggctaccggttaatcaagccttgtttgggaatagcgcattgccatacgtgttagtttattacatggccaataccaccattttctggacgctgggcgtttatttgattcaacgtgacggtactggcaccgctaagtttgacttgaagcagacactgaccaagatcttctcaccgccattactaggatttatgattggtgtcttgcttgttctaggaaacattcacgttccaaaattcttgatggatgatttctcatatatcggcggtctaacgattccgctgtccatgatctttattgggatttcaatggccaacgccgggttaagcagcatgcgcttcgaccgggatagcttgggaattttacttgggcgttttatccttgcgccggtactgatgacgctgatgcttattccaatgtcgattccattggagatgaagcaagtcttcattctgcagtccgcgatgcctgtcatgacgaacgcgccagttgtctccaaactgtacggggcggatgccgattatgccgcggtcatggtgacagaaacgacactactgagcctgatcgttattccgattttgatggtgatcgttcaagccaactttattcgttaattattgtgtgacttaaaattaaaagtacccgaatgcgtgccactagtgacaggcgttgcgggtgcttttttgctggctattaatgatggaaattcaatttagttcggtcaacaaggtttgatcaattagatactttctgctcagggctgtcccaacacgtctcactggtagtttttaatgacaagctgatgagtgcgtgctggatgatggttgaggcggcaagatgccattgaatggttcaagcctgatgaaaattgttttcaaaagcaattaaaaattgaaaaaaataacgcctgattccgcgttaaaaggcgtttttccgcggataaaagcgaggtagtatactgagctgatttgaaagtcacgtgaaaatggtgctatactgagaaccgttgcgtattaaattttgattaagaaggaagcgaacgtttcgtgaagaaagcatatctttacattgcaatttcgaccttaatgtttagttcgatggaaattgcgctaaagatggccggcagtgcctttaacccaatccaattgaatctaattcgattttttattggggcaattgtgttactgccatttgcattgcgggcattaaagcaaaccggacgaaagttagtgagtgctgactggcggctatttgctttaaccgggctagtgtgtgtcattgtcagtatgtcgctttaccaactcgcgattacggtcgatcaagcttcgactgtggccgtattgtttagttgtaatccggtatttgcgctattattctcctatttaattctgcgagaacggttgggtcgagctaacttgatctccgtcgtgatttctgtgattgggttgttgatcattgttaatccggcccatttgacgaatgggctcgggctgttattagccatcgggtctgccgtgacttttgggctgtacagtatcatctcgcgttatgggtctgttaaacggggcttgaatgggctgacgatgacttgttttactttctttgctggtgcgtttgaacttctagttttagcttggattactaagattccggctgtcgccaatgggttgacggccatcggtttgcggcaatttgctgccattccggttttggtgaatgttaatctcaactatttctggttactattttttatcggcgtttgtgttactggtgggggcttcgcgttttatttcttggcaatggaacaaaccgatgtttcaacggcttccctagtattcttcattaagccggggttggcgccaatcttagcagcgttgatcctccatgaacaaattttgtggacgacagtggtcggaattgttgtgattttgattggttccgtcgtgacctttgtcggtaatcggttccgtgaacgggatacgatgggtgcgattgagcagccaacagcggccgccactgatgatgaacatgtcatcaaagccgcgcacgccgtttcaaatcaagaaaattaattaatcgtggacggtcagggtgatattaatcagcttgaccgtttttttgtggcaagcgcgttatcgcacgtaacagctggttgtgactttgaaaaatgaaccaaatcgattatcataggaagtattgaagatagtaggtgggaaagagaatgacagaactagtattggttcgccatggtgagagtacggccaatcgggataatacgtataccggttggagtgacgtcccgctaacagcagtgggtattgcacaggctcatcaagctggcaagcgattacgagctacgggactgcagtttggcgctgtacatacctcagtcctaaaacgggctatcgttaccgcgaatattatgttaagtgaaattgatcagttatggctgcctgagtataagacgtggcggttaaatgaacgacattacggtgccttacgtggtcaaaataaggatgtgactcgtcaagagtacggtaaggcgcaagttcaacagtggcggcggagcttttatacggtgccgccgttgttgacaccggctgaactagaccatgatcgacgttacaccaagtacggtgccgccgtcgaaccgcggggagaaagcttgaagatggcttacgaccgcatcatgccttattggatcgatgagattgcaccgcggttgttagacggccaaaaccaactcgtggtggcgcatggtagtacgttgcgtgcgatgatcaaatatttagagcatattagtgatactgggattgatggtgtcgaagttgctaacggggtgccaatttgttatcaccttgatcagcaactgcacgttatcggtaaagaagagtattaaatttagtaatagttctcctaagcggtacttttattgaaagtaagtgctaatctggactgcttttttagaccattatcagattaatcgagcctgagttaagagcttcagcagacgctgaagttctttttttagttaaagtgttaaataaatgcccagtataagtaattataatcattgataataattgccgacgagtactcaaaaaatgatacaggcttaaaaagttgatataacagtgctttcataactgtttgagttaatataaatatttttaatgtaataaaatccttcagttttcataaataaatataatatataacttgtaatagaatggtgaacgctgtaacatatcagatggacaaagttgcgatttggcgcgcttgacagccaaaaatctgatcagaaagccgggtaacgttatgatgaaacataaaaatttattattattaattataatgagcttgggtttctgcgggatgctgttgatgtttgcgccacaaatcagtacgctgatcaacccgaatgcgtcgcgagttgaagcggataaggctagtggtcacgatacgacgcatgatcaggtctactacaatgatcagatggataactatcaatatgattatataaataacgggactaaggctttgaactataaggcccgttttaagagtcgggtcatcacgtatcggatcacgagtgacagcaaggtgtatcgagcgatttggctacgagccgtggaacgttggaataacactaacgcggtgaggttagttgaggctaaggaccaagcgaaagcccagattacgttgggcgagagtgaagacgagacggagacgaccggatcggaaatcggccggacttggcggacgtactatcaaagtggttcgcaaggaacaacttggatggattcggcgaagtgtgtgatttacacgaatcgctttccagccagcaatcattcggtagaatataagctgtccgttgcgacccatgaattgggacatgcactgggactagagcatgagaacaataagagtgcggtgatgtattaccagtcgcatcgagcagcacatatcacgactcgtgagattagtacgcttaagcagatgtataaataattataatagtgattgctataagtaaacgtaataataaaaaaatcgactaaactcacgcgagtttggtcgatttttttattgtttgttgttagtagttccttgagcggtagttaagtctaatgcagtccaaaaagcaccatcacgctaaagcagtgatggtgcttaatttagatggcccattaaacttaattaggctaatgcacccattggatcccaaggtgctaaaacagttggttcttcggcttgggctgcctttaagtcatcggacaagaattccttgttaacaacaacttggtagcagtattcgtccatccaagcatcgctcatgacgaagaagcccttagtcccaactttgtcgccccagctattttcaaccttccacttagttggttggccgtcaacgaggtcgacaccggtgataaccatggcgtgggtcatcagactttcgccgtaatcaagacgttcagccttcgacattgaaaggtcaacgtcgaataattcatctttactgtagacatcggtagccatgacccctttttggcggtcggaggattgaccaacatcacaaccaaaccagacactttggccagcttgtaattgcttgatggccaattgcttgaagtcggccatagacacgttcaaatgtttgacttcacggccacctaagacgttacctaacatttcaatcgtgtaggtatggttataaggcttgtcgtcggttggggcgttgatgattgaaacgtaatcgtccaaattccagccaacgtacttttcgaagaagctttgtggcgtcaagttttggtcgatgtggtattgtttcttatcatcacgatattcccagtcaaaatgtgaaacgggttcgccaaaggcataggctaacatgcgatagacttcgtttaacattttttctttgcgttcttgaatcgcgtcgtcactagttccggcagccactagttcacgtaattcaacggcatctttacgtaactttaagttaagtgtgctgttgatttcagccgattttgaactgttgtaagtttcaggcatgacactcttaggcacgataccgtacttctgaataatggcaacgagcatatcccattggccaccatcttgttgtggcgtggtcatcaaccaagcaactttacggctgctagttggttggtcagcggttgccaacacgttttcatagaaatagttcgctttttcgaacttatcccagaaaaaggtgtagttttgtgatagttcgaaatgtttcaagttgaatttttcagctaatgaatgccgcatcgtgtttaaagcggcgaacatccagcaacgaccactttgcttttggttcgcaacgtcacctgtatccaaatcaatagaaaatactggtgtggtttggctcatggcctgaatatcttgactgcttgctaagataccgttcttagtgacactacgttcgatgacttttgcttcgggacgttggtccaagtcggcttgaaagttagcaatttggttcatactgattgctttactcaaaagatcactctcctttaatctaattctaattgtatcggtttatgacgggtggggcaagccgggagtcgcacaaaactatggtcgtgcttcgataacctcgggaccattggcatgaccgacaatgacagtgttgaccatgtctaagaacaggccgtgttcaaccacaccaaccatgtgaattaaatcttcggctaaagcgtggggatccgtgattgggtcgatgtgtaaatcgatgataatattattagaatcggtccggacgagttcatcgttgactttacggaatactgggttatagccccgggcagccattttttcaaagacatgttggctgccgtaaggaatcacttcaacgggtaagccaaaggcacctaattgatggaccattttgctttcatcaacaatccacatgactttatcagaattgatggcaacgattttttcgaagagtaaggcggcgccaccacccttaacgccttggaaatcatcggcgatttcgtcggcaccgtcgatcgttaagtcgagatggtcgacttcgtcaacggatttcatcgggataccgagcgccttagcttgggcagcggttcggtcggaggttgagacgccgacaatgtttaaatgttcatttttgacccgttcacccagagcatcaaccatgaatttaacggttgagccggttccaaggccgacctgcatgccgtcttgaatgtattcaacggctttttgaccaacaagttgttttaactgatcctgattcataatatgaattactcctttgattgagaactagtgactaatacgtcggcagcttcagggtgccgatcaaagtaagccttagcgtaggtacacagtggctgaatacgtttgtgttcaactcgagcggcgtcaataacggctttggttaattggccggcaatgccctgatgaccaaaatcgtcacgaacaaaggtatgttcaatgacccaggtctgatcattattgatggcggggaaggtaatttcaccagccaacttgccgtgatcgtcattaaaataaaagcggtgtgcttcacgcgtgaattccattgatttcaccaccttgtaaagggttttatatctaccgtaattaaaccggtaattgcccgttttgtcaacgaaacttctataataaaagtatggtaaaatgtgaacactaaattaatgttgagaaagtaggaatttgaaatggcacggggatttgaaattgtaagtcaatacgcgcaggcggggttacatgtaccttaccgcaccaccaagcaagcagctggctatgacttcgaagcggcggaagattttacgttaccgtcaatttggaaaatgaactttattaaagtactttggcaaatacatcatggtgaaacgagttctgcagccgatttggatgcggcggctaaagtccttaaaccatggcttgttccaacgggtattaaggcatttatgaatgatggcgaatacttactattagccaatcgttccagcaaccccttgaagcgtaacttgattctaccgaatgggattggcgtcattgacgccgactactataacaatcccaagaacgaaggtgcgattttcgtccaattaatcaacatggggattcgcgacgttcacattaaaaagggtgaacgcattgcccaagggatttttaccccttatctgactgttacggatgaaacgaatgtgacaacgacacgttctgggggcttcggttcgaccaataaataggaaataataaaaaatcggtaaagccaaggtgatttaaaggctttaatggttaataatggtaaaataaacttatacccatagcatgaaaatgacgatccagttaattgagtttgattgattatttaagtctgcatcgtactggctggttgtttagtaagaatcatgattaaaaggtgccaattagatagatttctgttcgtctgcaatgactatcctattccgacctccgggactgggtgacaattgctggaacgtaagccgacgtcgatttgagctaacgcataacccgcgtcatctcaaatacgagtcttattctaagccggaagaaagacacttccgcctaagaataatttggctactgagcattgtcacccagcccctccagccgggaagtcgctcgaatggcaaataaacggccgcttaacttggtacaattggttgctgactactttgatacgaaaactttgagcgaaacatcagaatgtattctctactttgtcgaaacgttcaatgtattatgactggtaactcagaaatagtaagtcatcacaatatcattttcggcctgacagttgattgagaaaattaccgtttatgaaaaacaacgaccaattcatcaaaagttgagtacatcttcatcagctattcgaataccatcccgactggaaggtgtttctgacaatgcccagtactgcaagagtgtgaagtctcagtctgacccgaacacgtttcaccaatatggcataaaagcgtgaaaggccagtatttaagacgtgggcttcggctcaaatctgtgcccaccgcgttccggcaattggcagaaatgcctggaggtcggtgtaggacgaattaactaagcaagtttacgctaacccggactgtttccagcgggcctaagctggctgcttttaaatttaaaaaacggcacgttttaatcatgactcataacagtgtgacgcggatgaagtaattattttagaaattccaatacccaacattaaattgatatgttggcggagaaatggagacgtgtgtacgtggcaaaagcaaaaactcagtttgtttgttctaactgtggttattcaacaccgcgatatttaggacggtgtccgaactgtggtgaatggaatacactaactgaagaacattttgatacaaaaccggaccgcaagtcgcgggtgagctttgcgggtaagtcggctaagccacaacgactcaaagaagtgtcgctgactaagacaccgcgtgtcaagactaagctgaaagagttcaaccgggtcttaggtggcggtgttgtgccaggttcactagttttgatcggtggtgatccaggtattggtaagtcaacgttactactgcaagtttcggggcaattggccgagacgggtggttccgtactatacgtgactggtgaagaaagtgcctcccaagtgaagatgcgggcggaccggctggctgttagcagtgaagacttttatctttatcctgagactgatatgtcgaatattcgttcaacgattgaatcgacgcatccagaatttgtggtcattgattcggtacaaacgatgcaagaacctgatatggactctgcgattggttcggtatcacaaatccgtgaaattacggctgaactactgcaaattgcgaagactaacggcattaccatttttattgtgggtcatgtgactaagggtggtgccattgcggggcctaagatcttagaacatatggttgataccgttttgtactttgaaggtgatttacatcatacgtaccgcattttacgggcagtcaagaatcgattcgggtcaacgaatgaactgggaatatttgagatgcgaacgggcggtttgtatgaagtggccaatccctcagagatcttcttggaagaacgtctgaaggatgctacgggttccgccatcgttgtttcaatggaaggaacacgaccaatcttagtagaagttcaagcgctggtaacgccaacggtctttggtaatgcgaagcggaccgcaagtggcttggatcataatcgagtctccttgattatggcagtgttggaaaaacgggcgagtctaatgcttcagaaccaggacgcgtatttgaaagcggccggtggcgttaagttagatgaaccggcgattgacttagctattgcggtcagtgtggcttctagttatcgtgaccagcagactcgtccgagtgactgttttgttggtgaagtcggtttgactggtgagattcggcgggtcaaccggattgaatcacgagttggtgaggcggctaagctaggttttaaacgtatctttattcctaagaataatctgcaaggttgggatatcccaactggaatcgaagtaattggagttgccacgctaaaagaagcgctccaattagcattacaacaaccaaattattaaaaaggggctgatgccatgaagaagttaacggtgcgactagtatttattgtcgtcgggggtacgttaggactaacttacctgccgttcttgtggacgacaattttgtcgcaaccaaatgtgttattgaataacgtttttaccaactttttgttgggggcgctgattctatgggttttgtcattgttcttagccaatgccgctgtacgactggtggatcgagtcgaaaagaacttatccaagcaaaatccaatgacacttttatttggcagtatcggatttattattgggttattgatcgcggttctgatttcgcaattatttaatcgtagtccattattcctattgaacacggtcgtcccaattattttgatgttgttttttggttacattggtgcgcgagtcgggactacccggatcgacgagtggcggaaagttttcaacttccgccgtcgtgaaaaggaaacaagtccggagattactgatgctcagccagatcagaactatcatcattataagattctagataccaacatcttgattgacggccggatttacgacattgtcaagactggtttcttagaagggacactgttagtaccgaacttcgtcttgtatgaattacagtacattgcggattcagctgatagtattaaacgtgtgcggggtcgtcgcgggctagatattttaaataagctacaaaatgaaaatattatcccggttgaaatgtacgagggcgattttgaggatattccagaagttgatagtaaactcattcaattggctaaaaaagtcaacggtgtgatcgtgacgaatgactacaacttgaataaggtgattgagttccaaaacgtacaagtcctcaatattaatcagttggctaagtcgttgaaaccacgggttattcctggtgaagagatgaatgtcatggtcgtcaaaaatggtagcgaacgccaacaaggggtcggttacttggacgatgggacgatggttgtcgtcgaagatgggaagttttacatcaatgaaaaggtggatgtcgttgtaacgagcgccttacaaacggatgctggtcgaatgatttttgcccgtttagcacacgctaatcgcggaatcccggatcatgcggatggaaataataagcacaacaataatcatagtaataatcgaaataataatcgcgataatcggcactaggttaagcgattcaacggtagcaactcagttgatgggggctaccgtttttttgttcaatgatgactaatccaggacgtcgtaagggaggcggccgaatcgcaacaaaataggagggttaatgctcattatcaataaattgggatgttgttagtgtacgattagcgcctgtttcgatatttttacaatgggttcagtctgaaaccttaatttttagcggtaaacatggtaaactggaaaagcaagtgaaagtcggaatattctggtcgatagaaaggttccggcgtaacatttaagatgaaaaaatacgaaagaggcgttaatcacattggcaaagagcaagattcgtgtgcgttacgcaccaagtccaactggccatttacacattggtaatgctcggactgcattgtttaactatttatttgcccggcataataagggaaagttcattcttcggattgaagacaccgatttaaagcggaatgttaaagacggtgaaaagagtcagatggacaatttgacgtggttagggattgattgggacgaaggtccggataagggtggcgactttggcccttaccgtcaatcagaacggaaatcaatctatgacccgttgattcaacaattaattgatgaaggtaaagcttacgaatcttacatgacggaagacgaattgtcggcacaacgtgaagctcaaaaagcgcgtaaggaaatgccacactacgtctacgaatttgctggcatgacggaagacgaaaaacaggcgaagatcgcggctgctaaggcggctggtatccaacccgttattcgcttccacgtcccagaaaatacgacctatgcttgggatgacatggttaaaggtaaagtttcgtttgaatccaagacggttggtggcgactttgtcatcaagaagcgtgacgggatgccaacgtacaactttgcggtggttgttgatgaccatatgatggaaattagccacgtcttccgtggtgatgaccacgttgccaacacgcctaagcaattgatgatttatgaagcctttggttggcaaccaccgaagtttggccacatgagcttaattatcaataccgaaaccggtaagaagttaagcaagcgtgacgaaaccgtattgcaatttatcgaacaataccgtgaattgggttacttaccagaagcaatgcttaacttcatcatcctactaggatggtcaccagttggcgaaagtgaattgttcagtaagcgcgaattcatcaaaatgtatgatgaaaagcggttgagcaagtcaccagcagcttttgatggcaagaagttggaatgggtgaacaaccagtacattaagaaggctgacgaaaatgaagtctttgcaatgtcaattcgccaattgatcaaggctggccggttaccacaacgcccagatatgagccagattgaatggacacggacgttggtttcattatttaagaaccagatgagctatactggtcaaatcgttgatttagcagatctcttcttcaatggtccggctgatatcaatgatgaagctaaggccgaacttgataatgacacggcactccctgtcttgaaggaattccggcaacgaatcgaagatattgacgtcttcgaagcaaccgcaattcaaaagacgatcaagagcattcaaaaggatacgaagatcaagggccgggcattatacatgccgatccgaatcgccgtttctcacgaaatgcacgggccagaattaccagaaacgattgaattattagggcgtgaaacgaccaagaagcatctcgatgctatgattgcggaactcgccaagtaatgaatggattattaaaatattagttggttgtcgtaagtggcggtcgtcgtcagcaagacaacgcaattaatacatcgtgcggtcagcaagctagtccccgggtgagcgttatctcagtatcgcgaaagttacccagtggcgcgtgactgcatatgaaagtatcttttgtatggtggagtttcggttccgccgtgcgagggatgctttttatttgtgtttcaaacatggtaaactatcatcaaaagtaatgattcaattgaaaggagttgtcgccaatatgttaagtgtttttaatacgttaacgcgtcaaaaagaaccgtttaagcctatcacccccggagtcgtgaaaatgtatgtctgtgggccgaccgtttataactatattcatatcggtaatgcgcgttctgcaattgcctttgatactatccgacggtattttgaatattgcggttaccacgttgactatgtctccaacttcacggatgtggatgataagctgatcaaacgtgccgctgaagatcacaccacggtaccagcagttgctgaccggtttattaaagcttttatggaagatacgactgcggtcaatattgaaccagcgacggttcacccgcgggcctctgagaatatcccagaaatcattgcatttgtacaagcattgattgaaaagggctatgcttacgaatcagctggcgacgtatattaccgcgcacggaagtttaaaaagtatggtcagttatctgaccagcgaatcgatgatttagaagtgggtgccagtcagcatactgccgatgaagaaaccgatcgtaaagaagatccaattgactttgcactctggaaagcagccaagcccggtgaaatttcatgggaatcgccatggggtgcgggtcggcccggctggcatattgaatgctcggtcatgtctactaagtacttgggcgatacgtttgatattcatggtggtggtcaggaccttgaattcccacatcatgaaaatgaaattgcccagagtgaagcgaagaccggcaagacgtttgccaattattggttacacaacggttttgtgacggttggcgatgacaacgaaaagatgagtaagtcattaggtaattttgtgacggttcacgatattattaaaacggttgatccgcaagtgctacggttcttcatggcgacgacccagtaccggcgaccgattcaatatacgcaggccaacttagacgaagcagctaataacttggataagttacgtaatgcttatcgtaatctcacgttccggttgcaagatgcgacgaacgggacggatactgcggtggcagaacagttacagacactcatcactaactttggaaccgcaatggatgacgatttcaatgttcaaaacggggtggctgctgtgtatgaattagctaagttagccaatgtctatgcagccaaggcaacggttcaaaaagagacgttgattgccttacagaaggcattagtgcagttgactggcgtcttcggcgtcacttttgaaacggctaatgcgacgctggctgatgacgcgattcaagcactgatcgatgaacgagaagctgctcgtaaagctaaggattttgctaaggccgaccagattcgtgatgatttgaaagctcaggggattattttagaagatacgcctcagggtgtgcggtttagaaaggaataatatgcaagttgattatcaacaattaaacgggattgcactcgcgtacctcggtgacgcggtgtatgaaccgtttattcgccaacatttgattgaaagtggttttactaaagccactaagttgcaccaccacgcgacccactatgtttcagccaaagcgcaagcggcactgatcgaacggatgcaggccgaagaagttttaacgccaactgaagtggacgtttttaagcgtggacggaatgccaagagtcatacgtcggccaaacataccgatgtcgtcacttaccggatctcaaccggttttgaagccgtttttgggtatttacaattgactcagcaggcggaccgaattgcagaactggcacagtggtgtattaaacaagttgatgaagggagggtttccagtgtcaaataacgaacaagaccaaacagcagctgactttgtaatcgggcggcaccccgccatggcagcaatcaagagtgatcaacaaatcaacaaagtctttattcaaagcggtctacaggccgatgtactgaatgacattgccaagattgcgaagaaacgtaatttgatcgtacagtacgtgccgaaacaaaagttagaccgtttaaccgacaacgccaaccatcagggggtagctgtgggggtggctgcttttgaatatgccaccattgatgatttatttgctgttgctaaggctaagaatgaagcgccatttttcttgatcttggataatatcgaagatccccataacttaggttcgattatgcggacggccgatgcagctggcgcccatggcatcattattccgaaacggcgcgccgtgggtttaaccagtacggttgccaagacgtcaacgggggctatcgaacacgtgaaagttgcgcgggtgacgaacttggttcaaacggttaaacaattgcaagaagccggtctgtggatctttgggactgatatgaacgggacggactaccgacagtgggatgcttccggtgccgttggtttgattattggtaatgaaggtaagggaatttcaccattacttaagaagagtgtggacgaaatgttgaccattccaatgattggtcatgttcaaagtttgaatgccagtgtggcggccagccttctgatttatcaaggctacacgtcccggcatccactgggaaaataagatgaaacaacaattattgattgtcgatgcttacaatatgattggcaactggccagaactcaatcatttaaaacaaacggaccggttgccgcaagctcgtgacgagttaattagcatgttgactgagtataaaaaaattacgggccttaatattagcctggtttttgatgcgatgtacgttccgggtaattctaagagttatcgccaagctgatcttgagattatttggacgagtaaagaccagaccgctgacagttatatcgaaaagtacgcgggtgaaaagcaatcgagagtacttcaagtgacggttgcgactagtgaccaggcagaacaatgggtaatcttttcggaaggtgcattacgagtaccagccttggaattacgacaccgcgtcaagactgcgctgaaagatgtgcgtcatactgccgtgcgcacccaggatttaggtgccgttcgtaaatcaccctggaatgatgatcaattatcggccttggatcagtaccgccaacaactagaacgcaatcacgttaaacatcatcacaagtaattaggtggttgccgcgagcgtgggttgtttctaaatcgtcataattaatatttaaattttgcaaaagataaccagtggcaatttaaggctcgaaagcagttctagtattaaaatatctagtaatcaaatgccccagttcagctgctgttcactagatgttaggatggcttgtcataacagttttggtgttatcggagtttgcgctggcgattgcattaatcggttggttagacagcgcagtggcttcttgcaactccagcggacgcgcgtactcgtcgccaacgggcttaagtaggtcgcacttgtctttggcgttagcaatattttgatattactaataattagtgcgatatggcactattaggttgatgaataggacgatcatagtagttttgatagccgcgtataagaggatttctgtgagtgctgaggtggctgaattgaaacgttcgttcgcttgtgacggtacaattaacccggtatattagcattacagatgctcaggggtgcagtttctgaaactagtcagaagcgaggaatgtcacgtgaatgaacagcaattgatccacttagcagcagatggtgatgatgcaagcattaatgcattagcccagcagtatgtgcctgttgtttggcggttgcggcggcaatactatgtccggaactttgacgaggatgattggcttcaagaaggtcgaattgcagtttatcgagcggctaaaaagtatcaacggctacggcaatgtagctttggcacttattaccgggtgctattgagtaatcagattattgatcatattcggcggacacaggctcgcaagcgtcgtccggaaggggatatcttatcactggatgttaatgatgaggatatcttatgcaatattcagacgctaagggcctcgacccttgatgtggttcatgttcgtgagcaggtgcggatttttccagcaatctgttcggcatttgaaggattggtttttatggatctattggcagggcaatcgccagaacggattgcattgagtcggcaagtggaagttgatcaagtggtcaacgccacggatcgatgccgcaagaagatgcgtgactttttacaagacactgcctgaaattgacattcgaaaagttccatgctaatgttatacctgatttattatggaggttttgtcgatggcacagaaaaaagttgcactggcatgtaccgtttgtggttcgcggaactacacgattgatgctaacccgaatcgaactgaccgcttagaagttaagaaattttgtaaatattgtggtaaacacacacttcatcgtgaaacgcggtagggggattagacatgcgcttatttaaattttttggtcaagttggacatgaaatgaaaaaggtgacctggccaacttggcgggaaaatcgtcgtgattcgtggacagttgtctcaacatcactgttcttcgtggcgtttttcgctttatttgattggattatccaattattattacaaatgttaacaagctggcattaatggctttttgaacaaatttttgttataataatggcattgaaagaaaacttcgtgcaaacgaggtttttttattttgccaaaagacattttaaaggagaataataatggtcgagtctgttgagaaaagatggtatgtcttacatacctacgctggttatgaaaataaggttagttctaacttggaatcccgtattcaatctatgggaatggaagacaatattttccgggtcgttgttcccgaagaagaagctcatgaagtcaagaatgggaaagataaagttgaaatgaagaagatcttccctggttacgttttggttgaaatggtcatgacggaccaagcttggtatattgttcggaatacgccaggtgttactgggttcttaggatcacatgggcaaggtagtaaaccaacgccattgttgcctgaagaagcggaacaaatcttgcatcaactaggcatgagtgctcggcataccgaattggacgttgaagttggcgaacaagttaccatcatcgatggcgctttctctggcctttctggtgaaattactgaaattgacaacgaaaagatgaagctcaaggttaatatcaatatgttcggtcgggaaacaagtactgaattggacttcgatcaagttgatcagattcggtaattaatttaagtaagctggtggatcatcttggcagaagtaattttagtcatcatcggcgccttagtgctcggtattttggggcgtatcacctttaaattttggcaatacgggcgaccgcagcatttgcggcagtcggtgtcggctaattcagcagatgatagcgccgtgacgctatttattccagggtatgcgggcaaccggttctcttttggtggcatgctacaacgctttacggccggtggcatcgccaataagtcattagtcgtaatgattgatcgacataatcatccccatgtgactggtgagctagacgcttaccgcccaatggtacagttgatttttgccacgccacgcgttgctgtacggcaacaggcggcaggcgtcttggcagttgtgcagtatttgattgcgcatgagcacgttcagacgatcaatttagtcgctcattcgatgggtggtgtggtgctctttcaatacttgacgacagctgccaaactggtcaatttaccggaagtccgcaaggttgtcacaattggtgcgccgtttaatgatagtgaggtcgggcagaatacgtatccgattgaaaaccacccgttgacggcgaccggaccaactaagaccacgcctgtttataattattttttgcgaacgctccaacgattgccaaacacgatttcgtatttgaatattgcgggtaacattggcgatgcggcgcaaagtgatggtgctgtcgctctgaatagtgcgttgtcattgcgctttttactgcgaccaacgcgtgaccagtatcaagaatttgtggtacatggtaagaatgcccgccattcacgattacatgaaaactatgaagttgatcgccaaatcgtccagtttttatatccagaagccacaaaaaaggttgctggtgaaaaatagatatgctacaatgatgtttgtgcgtcacgtatgcacgtttacgtgggaggagcaaaaactcagctccatttaccacatcacggactaaggaggaatgtctcgtggctaaaaaagtagctaacgttgttaaattacaaattcctgcgggcaaagcaacacctgctccgccagttggcccagctttaggtcaagcaggtatcaatatcatgggtttcacaaaggatttcaatgctcgtactgctgatcaagcaggtatgatcatccctgttgtgattacggtgtacgaagatcgttcattcgacttcatcactaagaccccacctgctgccgttctattgaagaaagctgccggtgttgaaagtggttccggtgaacctaacacgaagaaggttgcaactgtaaccaaagatcaagttaagcaaatcgccgaaactaaaatgcaagatctaaacgcagctgacgttgaagcagctatgcgcatgatcgaaggtactgctcggagtatgggattcaccgtcgaaggctaattcagtactgttgagtatgtcggacacttcatcaaaatgaatgtgtcaagtgggaggaaatctccgtttgaaccacatttgcaaggaggaaaacacttagatggcaaagaaaagtaaacaataccaagacgccgctaagctcgttgatcgtgacaaagcttacgatgtaactgaagcggtagacttggttaaaaaaatggatttcgcaaagtttgatgcaactgttgaagttgccttcaaattaaacgttgatacaaagcaagccgaccaacaacttcgtggcgcggttgtccttcctaatggtaccggtaaagatcaaaccgttatcgtttttgctaagggtgacaaggctaaagaagctgaagaagccggtgctgactttgttggtgaaactgatttagttcagaagatccaagacggttggttagactttgatgtcgcaatcgctacccctgacatgatggcccaagttggtcgtttaggtcgggttcttggacctaaaggcttaatgcctaaccctaagactggtacggttacgatggacgttgctaaagccgttaacgattcaaaagctggtaaggtgacttaccggactgaccgtgacggtaacgttcacgttcctgttggcaaggtatcattcgatactgacaagttagttggtaacttcaagaccattgaagacaccatcgtgaaagctcgtccagcctcagtacgtgggactttcatccaaaacttagttgttacttcaacctttaccccagcggtacgtgttgatttagcatcattttaaggattaaattctgaaaacaattgaccccgtgggtgatctgtgatagattactagaggttaagtaatatctctacctaagactcaggcggcttaacggccttaatctacctgccgaggacattgttttttctctatgtcttggtggacatagggatttttttataaatccctgaaccaaaattctgggaggtgaatctgttgagtaaagaaacaattgctgttaaagcacaagaagtcgaagaagttgcagaacaattgaagagctcagtatcagccattgttgttgattaccgtggtttgactgttgaacaagtaactgatttacgtaagcaattacgtgaagccggtgttaagatgcgcgttatcaagaacaagatcatggtgcgtgccgctgataaggccggatttgaagacttaaaacctgtatttgctggtcctactgccgttgccttctctgaagaagacccagttgctcctgcaaagatcttggctaacttcgcgaagaccgctgatgcccttcaattaaagggtggcgtgatcgaaggtaaagttgctgatcttgaaactgttcaagaatacgctacgatgccatcacgtgaagaattattggctacgatcgccaacttgttacaagcacctgttcgtaacgttgcatacgctgttaaggcggttgctgaaaaaggcgacgaagacgcagcttaatttgctgtcagtgtgttaaaaaaactaaaatataagttcatataaaatggaggaacaaaaaatggcttttgataaagatgctattatcgactcattaaaagaagcttcaatctcagatttaaacgacttagttaaggctatcgaagaagaattcgatgtctcagcttcagcccctgttgctgttgccggtgctgctggtggcgacgctgccgctgctaaggattcatacgatgttgaattaactgaatccggtgaccaaaaggttaaggctattaaggccgttcgtgatatcactggtcttggcttgaaagatgctaagggtcttgttgataacgtaccttcaatcatcaaagaaggcgtttcagaagacgaagccaacgatatgaaagctaagcttgaagaagttggtggtgtcgttacccttaagtaatcatttacttaacggaacgtcatcagaccacaccctactatggggtgtggtctttttttatctctggatgtggttttggtgcgaatcatcacgtgcatgaccacgcatataacgattactgagaatttatacttaggctaattgttagtgcaacttgatatcaaccgccgtatgattacggtgacttggcgttagaggcgtaaccgtattggattaagcaagtcaaaacaagcccaacagaacgtcgcatagtacgtctgttgggcttgttttaaaatttcacttgggttgaacttctggtcgacagggcactatcacttttgtggctgctgcgtgataggctgaatacgatgatcaatgatcgttagtgactgacctgactagtgccatcagtatagttcaaggtcataccgggctggatattgaaaatatagacattaaaactgacagcattgctaccaactgactgaccacgcatttgaacaccgcgggctagcagttcgttacctttgaaaatgggggtcacttgatagcggacgtagtttttcggactttctttcaaataggccgcaacttggttttcataggtcgtcatttcagggtcattcaaagaacgggttccggtcatgaggttcttgatattgttgttctgccccgttaattgatagccaatcagatgactgcggttgtaaagccaaccgctactgatgcgtttgttatgccaacccgttggtcgaacattcagggcctcacgttcagctttgggcatcagtgactgatttaagagggcattagcagccgtcacacggttaagtgagtctaaattgccatattgttgccaggcaccctgactcgtactgacctccttagcggtaaatgcgggctgattctgattaatcgtgatcgtttgttgaccgttgtaagttttactagccaacgtagtgttacttggattatggtcagaattgaccttggttggtgctgtggtcgaagttgcgccagcttgcttgttcttggttttcagtttgtcaatatgttgttgactactcgaaagctttttcacagcctgttttaagctgctagcagaagcacgattggtagcttgaagtgccgtcagttgcttgtcattattagccgttactaagtgtgtcctagtaacggtctttgtcttcacagttggctgagtggattcatcagatgtgccgagaatactaaagctgacgagcaatgcgataatggccggccaactatgccgccaccattgacgcccacggtagcgccgatgtaagcgccagaaccagtacagggttgcaaataataagatggtgccgatcaatgccatgaagtgatcctcctatcgaaatgacttacggaaaccagcggcccgcgctgcgtcttccgtactaaagtaaacggcatttttaccggccatccggtagttttgccctgtttcaacgtgataaattttggaattgcggttacccacgatacgtccggtttgggcggtatcggtatcgccagaaaaattattctgccgactcgtggttgcggtactagtttgagtttgttgacttttagcagctgcttgactgctggccttggccgcttgcttagattggctagcggctgcgacggccgaagcggactgggcttctgactgggagcgtgattgtgcggccgcttcactagcagctgatttggcggcagcctgtgacgctgattttgatgaggccattgcgtcgtcatgttttgcttttagttgttcggattgacgcttagcctgactagttgcaattgcgagttgggtcgtgtttgaactaagagctttggctgaggccgcgttagcccgactagcggcctttgcttttgcccaggcggctttattagcagcagtccgtttctcaacccgaaccgtcttggttttgacactggtatggttggcggcttgttgattaccagtggtacagccggttaagatgagtagactcgttagtgcaacgacgagttttttgcatggtgcataagaaattcctccttgtttatgtatcactttaattatacataaacggtaaaggttggtaaagcaagtttggtaactaaaaatcaattaatattggtttatgctggtattaatttcgataattaatcataattagtgctaactactaacacccattcggaacaatttagtaacaggtatttaaaatgttcatagcttaatacggcgacaaatcagacctgtgggggttattaacgacctataacggttgtataaacaggctaagattgcgataatagaacaaacacaccaatgggggaatttttttgaaggcaacgttacagaaaatcgggacggcactcaataaacgcatggggatcatcaaagcattatttgtattctctgtcctgttatttgtgattacggaagtcggcaaaattgcgaaggaagtcagtggcgcgcagttggcgaatgcgcttgcttcgcaaagctggtggcatctgttaagcatggtcgtgattggtattatcgcagtgacaccaatgctgacgtatgacgtcatgattacaaagtttttacccaaccactattcacttggctatatcttaaaagctggatggatcaccaatacatttacgaatatcggtggttttgggggcgtgctgggcgcctcactgcgtgctaacttttataatcgcgaagccactaagaaacaaatcgtgtttgccatttccaagatcgctttgtttttagtttcgggattgtcattatattgtatgatttcactcgtgctagtctatggctttggcattgggaacatgtatggcagttactggatctggctcgtcggtggtgcactgtattttccagccatctttatttttacacgagtcaacgattcggaattcttcgatggccttacgctcggcaacgtcgttcggttattgagtgggtcgtttggtgaatggactggctgtgtgctgttcttcttattaattggaaactttatgggattacccattgattttgcagcggtcgtgccgttattcgtgattgcttcggttgtcggtgaagtgtcaatggtacccggtggtattgggtcattcgacgttttcatgatttttggcctcggtgcggtcggagtttctcgaccagacgcagtcgcatggctcttattttaccggttattctactatattatcccgtttgccatcgggttggtcttattcatccatgacaccggccatcgcttaaacgtgcgcttagcgggtattcctaagcaggcattacaacgtgttgctcagatggtactgacggtttttctctatttttctggttttctgatgttgttaatgtcaacggtccctaactttgcatataacaataaactcttcttacaattttatccgtacacctttttctttattaatcaggccagcagtattattatggccttcttactgattggggtggcgttgggaactgctggccgggtcaaaaaagctttttggccaacggtgattgtcctgctgattgcaattttgaatacgattcgctggctcgtcgtttatgatgcaatttcgatgaaatttgtgattttcttgattgtgattctagcgctagtggctctatcgcggcatgcttattatcgtgatcggttggctttttcgtgggggcaaacgttgtgggttagctgcgtgtatgtggtgacctttatcttgtatacgattgtgggagtctataacgcgccccaaattcatcatcggcatgcggttcctgaagctctgttcttcccatcacaaaagctctggttatttggagtgattgggttagtcttagcggcaatgattttgattattatgtaccgctactttgcgagtggttataacgcccgattacgtcaaaagatggatgcggctcgggtcaaacaagtgattgaaacttatggcggcaatgaaatctcacacttggcttatttgaatgataagttagcatattactatcaagtcgatggggtcgatcaactgattttcttataccaacagaaggccgataaactgattattatgggagagccattcggtaatcaagcggtattacaagctgccttggaacagttattggatgacgcagatagtgacggttgctcgctagtcttttacgaaattagtgagatgctgacgatgcgcctacacgaaatgggctttgactttatcaaaactggtgaagaagggcacgttaaattggcagactttagtttggctggtaaacggctacggggtgagcgggccctaatgaataagtttacccgtgatcactatgagtttgccatcttgcagccaccgttcagtgccgacgttatggctgaattacgagccgtttcggatagttggttagcaggtgagacggaaaaaggattctcgctcggattttttgatgagcagtatctcaatcaggcacccgtagcggtcgtttatgatcctgaccaccgaattgtcgcgtttgcgaatattatgccgcagggaaatcatcagacgacttcaattgacttaatgcggtcaagcaaatcggcgccatccggcattatggacacggtctttgtgcacctatttgaacaggcgcgtgacgatggctatgcttatttcaatatgggaatggcaccgttatccggtgtaggggtttcacgctacagttttattcaagaaaaaattgctcatttaatttacgaatatggctaccagttatatggttttcagggattacggtcgtacaaagagaagtatgtgaccgagtgggaaccgaagtacattgcgtaccgaaaacgtaattcactaatcttcaccattttacaattgctacaagtcgttaatacccgggtacacaagtctgagcggcaccggccagtatggttgttgaaacgattgaaataactgaatagtatgtcataaagtaagtatcgttaatgacatagcaaaatgccccatcactgcgagaagcaatgatggggcattttatgatgactttagaattcagccgactaatatgatgagggctgaactaattgtggcagaagcactagagctgttttgcgtaggctagattatttagttcgtatacttaggcggtaacacatgtttgaaatcatggaaaccagcgaaaatttcatcaagatcatgcccattaatgaataggtcgaggttagcctcgggggcaaaccctaagtcggcggtcttttgtagcatggcgactagatcgtcgtagaagccgtcgatgttgtagagcgcaatcggcttttggtgaatatccatttgactccaagataacatttgtaagaattcttcaaaggtgccaaacccgccaggtaaaacgataaaggcgtcagcgaggtgaagcatcttttccttgcgttcggtcatcgtgcgcgtttcgataaaagtcgtgacgtccttaaatgcaagttctcttgcgaccagaaaatgcgggatgatcccgataacgcggccaccagcatccatagttgctttggcgactttccccattaaaccatggtcgccaccgccatagacgagttggtaatcattagcggccaagtattgaccgagtgccaccgttttctcactaaatgcgggatctaaaccagaattagacccacaaaaaacacagatattatgaattgccattctaaactacccccaagataaaattttctagcaaaaatgcggcccggataggcgccgcatttttgtgaactaacgtgttgattaatcgtctggattaccaatatcgtagtcggtgtcttgcattgcttcaacttgacccaagcggtaaccattcccaacttgtgagaagaagtcatggttagaagtccccgttgaaatcccgttcatgacgaccgggttaacgtcttccgcagtatctgggaagagggcatcttggccgagattcatcaaggctttgttggcgttataacgactaaaagttaagacttcatcagaccaaccaatttgatcgtaaactaaatgaatgtagttttcttcattctcatagagtttgtataagaaatcgaacatccagtctttaaattctgcctgctgcttttcagaacggtctttgaagcctaattggaacttataaccaatgtaagtgccatggacactttcgtcccgcaaaatcaatttaatgatttcggcaacgtttggcaattggttgtggcccaagtagtacagtggcgtatagaaaccagaatagaacaggaaagtttccaaaaagacgttcgcaactttttgcttcaatggatcttcgtcgatgttatcgtaaagcttgtagatccattgggcttttgcttgcaagaattcttcactgtcactccagtcaaaaatttcattaatttcgtccggcgtattcaatgtttcaaaaattgttgaataactctttgcatgaacggattccatgaactggatgttattcaatacggccgtttcatgtgaagttaagacgttgcggcgaagtgcttgcagaccgtcttgtgattgtaacgtatctagcagcgtcaaaccgccgaaaacgtgtcccacgacccaccggtgatcatcatctaattcacgccagtctgccatgtcgttggaaactggaatccgggtgtctaaccaaaattgttcggttaacttttcccaagtacttttatcaattgcatctgaaactcgatcccagttaattgccttatagttgccattactgagcagtttttggtagtaagccaagtctgttgccatttgttatcctcctagagatctaagatactaaattacgcagctttcacattcgttaacaccgacttcgccatcgtcgtccgtaaaggtccgaatataataaatcgatttgatccctttgcggtaggcgtagttccgtaaaatgtttaagtcccgcgtggtcatcttatcagtgcgaccatctttccattcgtataagccagctggaatagttgaccgcatgaagagggtcaagctcattccttggtcaacgtgttgttgagcagccgcatagacatcgataactttacgcatatcagtatcgtatgctgacttataatagttaattgtatcattagataggtaaggagcgggataataaatcttaccaattttcttttcttgtcgttcttcgacccggttgatgattgggtgtaggctggcagttgtatcgttgatgtacgaaattgacccatttggggcgacagccatccggttttgatgatagaggccatcacgcataacggcttctttgagggcttcccaatcagctttggttggaatgaagataccgtcaaacagtgcaacggtatcttcatattttggttgccaatcttgggtggtgtacttgtcaaagtaagaaccatcggcatacttggatttttcaaagttaacgaaggtttcgtgacgttcacgcgcaatttcgttagaagcttttaaggtccagtagtttaagagtaagaagtagatattggtaaagtcaacggcttctttactgccgtattccatctgattcttcgcgaaaaaggcatggagccccatggcacctaacccaatggtatgggcttgacggttccctttttggatggaaggaacgacgtcgacgttagagtggtcagtaacaaaagttaacgcgcgcaccatggcttcaacagaatgtccaaagtctggagaggtcattaagttaacaatgttagtcgaaccaaggttacaactaatatcagttcccaacttctcatactgttgttggtcatcaattaatgatggggtttgcacttgcatcacttctgagcacaagttactcatcacaattttaccatcgataggattttcgcggttcgcggtatcaatgttgacgacgtatgggtagccagattcttgttgtaacttgctgatttcattttcaaggtcacgcgccttgatcttagttttacggatgttcgggttcttaaccatattgtcgtattctttggtgatatcgacatatgagaacggtaccccgtattcgcgttcaacgccgtaaggactgaagagatacatatcagcgtcagccttgatcaactcgtaaaacttgtcgggtacggtgacaccgagtgaaagcgtcttgagccgaatcttttcgtcggcgttttccttcttagcagaaagaaaggcaataatatctggatgaaagacactaaggtaaacgaccccggcaccttgacgttgacctaattggttagagtaggagaaactgtcttctaataatttcatgacgggtacgaccccactagcagcgccatcgatatgcttgattggatcaccggcaccccgtaagttgctgaggttaataccgaccccgccaccgatccgagaaagttgtaacgcggagttaatcgtccggccgattgagttcatatcatcggtcgattgaatcaagaagcaagaaatcaattcaccacgccgggcccggccagcattgagaaaactgggggtggctggttgataacgttggtgaacgatttcgtcggccaggtccatcgccaagtcttcattaccatcagcaaagtagagggcgttcattgccacacggtcaataaagttttccaagtaatagtcgccatcatccgtctttaaggcgtattgggcataaaatttgtaagccgccataaacgtcttgaagtggaagtcttgcgaccgcaagtaatcgtaaagtttttcgataaagctaaaatcatacttatcaatggcaggggtttccaaatagtcgtgttcacgtaggtagtcaaagcgcgccttaagactatcaaatttcatcgtgttcggttcaacattttgttcaaggaaagcggcaagtgcctcctgatccttgttgagcggaatctgattgttaacgggaatattgatctcattatttaagtcgtaatacgtgacgtcttttaaatcttttaaggtcataaggaatcctctttctatcagtataattgtggctggcaaaatcgacgacccacaatcagtaggttgatgattgtgggtcgtttatcatattttaaagggtaaaccagctatgtaaccacgcaaaaaagcgtgaacaaactaaacagctaattgttttaaagcatcaggacggaagccggcaatgctgtcttcgccattgatttcaacgaccggaacagcatggaaaccttgattcttcaggtaatcgacgtattcaggattcgtattgatgttcttctcttcaaaggcaatattgtgcgccgtgaggaacttcttagtcatcttgcattgcatgcagttgtttttagtaaatacagtaacttttttcatttttcatcatcctaactcgtttttttgataaatttagtatacaacatgtggtgaaaaaaacaatcaaaaaacacaacatctagggtgtggtaaaaatcacaagccctagatgttgtgttagtgtcagcttttaaccgactaaaaagttttttaaattatttgtggttcactcgctgaatcagttatcatagatatagaccagaaatttagaggaaaataaatatgaccaactattattatacacacaatccggatattgtgcatgatgaaaagcaatggaattttgaaatttttaatcactcgtttaaatttacgacggacaacggtgtcttctccaagcgtaccgtggattacggctcacgaacactacttgcagcgtttgatccaactgatttgccagcgggcccaatgctagatttgggaactggatatggtcccattgggatggcgctcgcgtatcaatcacccgaacgaacggttgatatggtcgatgtgaacgagttagcgctaagcttagcgcgtaaaaatgttgctttgaaccaaattacgaataccaatatttttacgtctgatgtctatcaacaagtgaccgcgactaattacgcggcgattgtcaccaacccaccggtgcgcgcaggtaaggcagtggtggatgcgatgttaacgggggccgtttcacggctagtcgttggtggaacactcaccgtcgttttacagaaaaagcagggcgcaccatctgcgaagaaattgatgcaaacgacatttggtaattgtcaggtgattaagaaggacaaagggtattacatcctacaaagtgtaaaggagggatagtcgtgacggaaccaacagcggaagactggatgcaagaagcattacatgaagcgcggatggcctacttaattggcgaagtgccgattggggccgtgatcgttcaccagggtgaaattattggccgtggtcacaatttacgggagcatggtcaggatgcaacgatgcacgcggaaattattgcgattcaggaagcttgcgaatatttgcatagttggcgattagccgattgtcagctatatgtcaccttggaaccatgtttgatgtgtagtggggctattattaatgcacggctacctgaactctactttggtgcccgtgatcccaaggctggcgccgttcgtagtttgtatcaggtgatggatgatacccggttaaatcatcaagtaacggttcatgaacgcatcttggcacgtccggccggcgagatgttggaaaacttcttccgtgggattcgtaaacggaaaaaggcggctaaaaaagcacgacgtgaagctgctgaaaaaaattaagccgatggctggtaattgtggcgcaaatcatgtattatagtatttgccgcaaggccaaaaggcaagggtggatttacgaatcgtgtcaggtccggaaggaagcagcactaagtttgcttcatcttgtgccttttgtttttatgaaatgtaacagctcttagccattcggttgagagctttttatttaaattaaatattgagtgctagttttgaacgtgctgataggttggtttatttttatttacctattattatagtagtaatacgttatttgggtgatgcttttcaggctgatagttaaagccactgcttgttgaaggaataaccaaacgcctaacaaaggtggttaaaggcctgggcatcgactcgttggcaagtgcgcttagatgcttaatttgcataaccgacactgatcgttagtggaagcagcacaaccaggaagctaactgttcaggacgtttaaacaatggcttataataagtaatgataaccaaagtatgactgatgtaagaaaggaagaatcgcatgtatcgggcactatatcgggtttggcgtccccaacgctttgatgagattgtcgggcaacagatgattacccagacactaaaaaatgccattatgacccaccagacgagtcatgcgtatctgtttaccggtccccggggaactgggaaaacgtcggcagcgaagatttttgccaaggcaatcaactgtcaccatcttgttgatggggaaccttgcaatgaatgtgagacttgtacggcgattaccaaggggcaactaaatgatgtcatcgaaattgatgcggcttctaataatggtgtggaagagattcgtgatattcgggacaaagcgaagtatgccccaacgcaagcggactataaagtctacattattgatgaagttcatatgttatcgactggcgcgtttaatgcgttgctcaaaacgctagaagaacccccagctaacgttatatttatcttagcgacaacggagccccataagattccattaacgattatttcacggacgcaacggtttgattttcggcggattacggctaaggatagctacgatcggatggtgtacatcctcaatgagaaggatgtgacctatgatgaaaaagcgctacgcgtcattgcagcggctgctgaaggtggaatgcgggatgctttaagtattctggatcaagtaatttcgtttggggataacacggttacgttggatgatgcgttaatggtgacgggaagtgtgaccaagcagttgctggctaactatgtcagtgaggtcaccgaccatgatacgaagccggcactagagacgatgcgacaaatcttacaagaaggtaaagatgcgaaccgtttcattgaagatttgatcagttatacgcgtgacgtgttactctatcaacaggcccctgaaatggtcgatagtgtggcgatgggcgaggatgatcaacaatttgaagcatttgccaagcaaatcgatgctgaagtcctgtaccaaatggtcaagacgttgaacgatattcaacaacaaatgcggttcacgacgcaccccgacgtttatttagaagtgttgacggtcaagctagctcagttggatggtcaagcggccgttcaaccggtagctgcggcaacggtcaatcctgaagatcccactgtgcataaactggcacaacaagttgaacagttacaaagcgaggtcaaaacgttacgttctcaaggtggtagtgtcactaaacctgcaccggctaagccgcggtcgagtaatggcccggttggtaagaaggttaatgtcagtcagatttatcctattctgggagcggcaacgaagaatgatctcattaaggtgcgcgatgtttggactgatttgatgaatattttgagtgtgacgcagcgggccctaatgcacgtggcccaaccagttgcggccagttcagaaggtgttgtggttgcgtttgactatgcgtttgtttatcaaaaagcgattgatgaccagaccttgatcgatgcactcggaaatggtttggatcggctgatgggacaggcacccaagattgtctgtgtgcctaaagaacagtggccacaaattcgtaaggattatttggccactcaccagccaggaggtgcaacatcagagcaacaagcaccggccaaagaaccggtcgttgaagaagctaagaacatgttcggtgatttagttgaagtacagccggactaaagacgaaaggaactgataattatgatgcgtggaatgggcaatatgcaaagtatgatgaaacaaatgaagaagatgcaggcgcaaatgacagccgaacaagcggctttaaatgaacaaaccttcacgggtgcggcgccagacgacatggtcaaagtcacttttactggtgataagaagatgaaggatattacgattaaccctgatgctgttgatcctgatgatgtggatatgttacaggacttagtcgttgctgcggtgaacgacgcgttgactaaggtcgatgaacagacacaaagtacgatgggaaaatatactaagggattacagtaaaaacgaggtaagtacatgcagtatccagaaccaattgctaagttgattgatagttatatgaagttgcccggcattggtggcaagactgcgacgcggctggcgttttatacaattgatatgaacggtgatgacgtcaccgagttcgctaagtcgctgattgcggccaaacgggacctgcatttttgtagtatttgcggtaatatcaccgaagatgatccgtgtgtgatttgtaaggataagtcgcgtgatcaaagcaccgttctggttgttgaagaggccaaggatgtcatggcaatggaaaagattaaggaatacaacgggctgtatcacgtcttacatggggtattgtcacccattgatggcaaaggtccggaagatatcaacattgccagtttattgaaacggctacagcaaaatgaagccatcaaggaagtcattattgccaccaatgccacgcctgaaggtgaagcaacagcgatgtacatctcgcggttagttaagccggcggggatcaaagtgacccgattggcgcacggcttgtcggttggtagtgatattcaatatgcggatgaaatgaccttattcaaagcagttgaaggtcgccaagaaatgtaattggaggtgccaccatgtttaaacgtaaacagaagatcaagcatcccaaggaagtttttgatgaacagttattgtcgaccctgaatgccgctaagttggactgggaccgtgcgaagcagaaccaagaagcggtctatgataataatacgagtgaactagttacgcagaccgccttagcgcgtgctaagtatttatatctgtatcgtgaagcacgtttacgtcaagttcatgggcagacgattcagcgctcggtcattgataaatagactgttagtgatttaagagataacttgtttcaaaataaagacgcacgtcgttgatttttgtaaatctacggcgtgcgtttttgatttagaaccctagcattattttaccagttaatctgtcatgcattgtgattaagacatgctaggtgcggcaattggaatagaagatgtgtatctactaatgaataacaaactaaaatcggtatttatcaatcgtgggtagtactacctaataactttttagcaattcaccgaataaatcatcaaaaccacaattggtagtagccgacccacgtaaaaatcgtgaaaaagtaccctcactagtggtaaccgtattagacaggtactcaaaaatcaagtacaattgctacatataagaaaatagatggggttgggaatgttgacaggaaaattagttacttttgaagggccagacggtgccggcaaaacgtcagctttaaacgcgattgtggccaaattacagccacaattaggggatcgcttagttgtgacgcgtgaaccgggcgggaatcaaatctcagaagcaattcgaaaaatcattttagaccgtcataatacggcgatggacgaccgtacggaagcgttactctatgcggcagcacggcgacaacatatcgtccaaaccattcaaccagcattgcagaacgaccaacttgtcttgtgtgatcgctacatcgatagctcggtcgcttatcagggggccggtcgtggtattggggaacaagcggtttatgatatgaatcagttcgcgaccgcggggttaaccgcagatttaacgttgtattttgacgtagatgctgccgttggattaaaccgcattcaacaacatcgccaaaatgaaattaatcgcttggacgtggaagccttaagttttcatcaccgggtgcaagcagcgtatttgagattactggctgatcatcctgaccgtatcaagcgcgtcgatgcaagtcagccattggaccaagttgtgacgcaggccttagagattatggcgttacagttaccgacttatgtggcatccaagggaggggaagaccaatgaaattaattattgcaatcgttcaagataaggacagtaaccggttgagcagccagttcattgaagccaatgttcgggccacgaagctctcaacgacggggggcttcctacgttcaggtaataccacttttatgatcggtattgatgatgaccgtgtggatgaagttttagccatgattaaagaaacgagtcatgcgcgggaacagtttatgacaccaccagtcaatctagacgtgacgatggatggcgcagctgcctatccagttgaagttcaagtcggtggcgccacggtctttgttctaccaattgaacaatttcaccaattttaatgaaggatgattattaatggcaacaaccgagtcatttgcgcaaacgttagcggcgaaacagccccgcttattagcggcatttaaacacatcatcgcccagaaccatctggcccacgcgtacttattcgcggggatggaaggcgctggacaaccagaactggcccattggattgcgcaacggttgttctgcctgcatattaatgatggtgaaccagatggcacttgtgaggagtgcgtccggattgctaatgggtcgcaccctgatattgtgacagtggctcccgagggtcagcgaattcacgttgatcaggttcgttacttaaaagctgaattctctaagagtgcggtcgaaggtaaccggaaactgttcatcattaatgatgcggagaagatgacagcgagtgctgccaatagcttattgaagtttattgaggagccaagtggtaacgtcacggccttgttattaacgactaataagcaactgatgctaccaacgattatttcacgaacccaggtgatcgaattcccaccattaaatgcgcaggcgttacagcagacgtttgaacaggccgggattgcgccaaaccaagcgcagatgttacggggcctgacaaatagcgtgacccaggcgcaggcgttgctagcggatgattggttaccacaagctgcgcaagcattgtggcggtggtttgaccaggctgttaagggtgatccacggagttttgtggctgtgcaggtcaatttagttggtttggctaaggacgctgatcatcagctggttatgttggatttaattgcggccttgttccaagatctattgcaattacattttgaggtggcaacgacagcgttaacctttggtcagtaccaaaaagaattggccgggttaacggctgaagtcagcgatgagcagttgattgcggcgacagaactagctttaacggccaagcgccagctagctagcaatattagttttcaaaatgtcttagaaggcttaacgttaaagttatggccgatttttcaaacaaacgcttaaataaaggaaaacgagggtgagcgcgtggataagcgtgatttatacgatagtttcggtgagatggaacaacagatgcaacaaatgctagacaaaatggctaagttacgcgccgatatgacaacggtgttagagaaaaacgcggaattggtcattgaaaatgaacatttacgtgaacacatggtcgaaattgaaaatgaattgccgaaaaaagcggctagcacgaccacgctctcaaagtcacggcaaaacttggaaaaactctatgatgagggcttccacgtctgcaaccagttttacggcaaacggcgtgacgatgacgaatcctgcgttttttgtttggaagtcatttatggtgaacgtgaacgcgcatagtcgaaaaagtctgggagtagtcccagactttttgtgcttttcaccacgagtcactcataggaacaagtcacggtcgagaggattgttaggaggacgttttggaaacacaacaaagttttgcagatcatgcgggtatcgggaccttgtacttagtaccgacgccaattggcaacttacaggatatgacttatcgggcagtagcgacgcttaaaacggttgacctaattgccgcagaagatacccggaatacccaaaagttattgaatcattttgaaattacaacgaaacaaattagctttcatgaacataacacccaagaacggattccccagttaattgaaaaattacagacgggcgttaacttagcacaagttagcgatgcggggatgccgtcaatcagtgatcccggcaaagaacttgtggcagcctgcattgccgcgaatattccagtcgtgccactaccaggtgccaatgccggcctgactgcgctgattgcttctggcctagtgccacagccattttatttctacggctttttaccgcgtaagaagaatgaacaaaaagctgatttggctaaattggctcggcgacatgaaacagtggtcttgtacgaatcgccattccgtgttgccaagaccttgaccctcctagcgaccgtctgtgaagggacgcggccaattgtggcgtgccgggaattgactaagcgttacgaggaattcgcgcgtggaaccttggctgaaatggtgacgtgggcgcaggatcatcagttaaagggcgaatttgtccttttgatcggtggtaatccggataaggatgaaccagaaacaacggatgaattggcacagttgccagtcaaagcccaagtcgaagcgttgattgcagccggagataagcccaacgtggccattaagacgattgcgaagcgacgaaatattccccggcaaagcgtttataatcaatttcatgaactaaataccaacgatgaggagtcttgatgaatggcaactttaggcgcaaatgcgagtctttacagtgaacagcaccggattacgtattatgaatgtgaccgcactggtcgcgcaaccttaacgacattaattgatattgccgtactggcatcagaggatcaaagcgacgcccttggtttaacgacggaaatggtgcaaagccatggtgtcggttgggtcgtcacgcaatatgccatcgatattacacggatgccccgccaagacgaagtcgttacgattgccgttcggggtagtgcttataatccatattttgcttaccgtgaattttggattcgggatgcagatggtcaacagttggcctatattacgagtatctgggtcatgatgagtcaaacgacccggcgaatcgtaaaaattttaccagaactggtcgcgccgtatcagtcggaagtcgtcaagcgcattccgcgcttgccacgaccgattagttttgaagcgaccgatacaacgattacgaagccgtaccatgtccgcttctttgacattgatcccaaccggcatgttaataatgcacactattttgattggctcgtagatacgctacccgcgacgttcttgcttcaacatgatttagttcacgttgacgttcgctatgaaaatgaagtcaagtacgggcaaacggtgactgctcatgcgaacatcttaccgagcgaagtggccgatcaggtcacgacgagtcatttgatcgaagttgatgatgagaagtgttgtgaggtcacgattcaatggcggactttaccagagccgattcagtaatttgctgggttggtatttacactagtgtgttaatgatgtgatcgtgagcgacttggtcgattagaacgcacgtttttattagagtcgctggcgattcagtatgctatgattaatacatccatacaggggaggttcattatgtcaattttagttttagggggagctggctacattggttctcacatggtcgatcgattagtagaacacggtacggacgtcgtggtcgttgataatttggtcacgggacaccgtgctgctgttaattcggcggccaagttttatcagggtgatttgcgggatgcggattttttgaatcacgtttttgatactgaggacattgaagctgtcgtgcattttgccgccttttcaatcgtaccagaatcaatgagtaagccactgaagtactttgataacaatactggtgggatgatcacgttacttgaaacgatgcaggcccatgatgtgaagcaaatcgtcttctcatcaacggccgctacttatgggacacctaagcagattccaattaaagaaactgatccacagttaccaatcaacccgtatggcgctagcaagttaatgatggaacaaattatgcactgggcggacgttgcctatggtattaagtttgtcgcgttacgttactttaacgttgcgggtgccaagccagatggcagtattggcgaagatcatggccccgaaacacatctggttccaatcattttacaagttgcgcaaggaaaacgcgatgaacttaaaatcttcggcgatgactataatacgccggatgggacgaatgtgcgtgactatgtgcatgttgtcgacttagctgatgcacatatcttggctttgaagtacttggctgcaggaaatgacagtaatgcctttaacctgggttcttcaactggtttctctaacaaacaaatgttagcggctgctcgtgaagttaccgggcaaccaattccagctaagctagcaccacggcggcctggtgatccagactcattggttgcggcgagtgataaggcgcgtgacgtgctaggttggcaaccaaattatgacaatgttaacgatattattgaaacagcgtgggcttggacgcagaagcatcccaatggctacgatgatcgtgactagtatcggttagctgataattgaaagcggctttgaaatctcgtcaatagatttcaaagccgcttttgtggtcgtcaaaaaaggtgcatgtcaggattgagtccttggcacgcaccttttagattgatcaatgcagttagcggtgaagttgttgataatcaccgataattgttaagagtcgttgaatatcagttgtatcaacatcaccgatggtaccaattctgaagctagggatatttgaaaccttcccaggataaatgacgaagccgcgttgcttgatgaactgatagaagtcagcaaaatcaaagtcgacgttcgggtatttgaatgacgtaatgatgggcccttgaatggctggatcaatcactaattcaaaacctagcgcttgtaagccgtcgctaaggagttgttgactagcacggtaacgttggtagcgtggtgtcacgccgccttctgcttgcaattcaatgagtgcttgcgcaaaggcatgtaccacgtgggttggcgaagtgaagcgccattttcctggttgcttggtcatggcttgccattggtcgtagagatctagacaaagtgaacgagcgttgtcagcagtgtgggccaaggtcgcttgttttgcaatgatgaacgcaaaaccgggcacgccttgcacacacttgttggcactactaatcaagtagtcacaatccaattcatcaatgctaatcgggacgccacctaaactggacatggcatcgatgatcgttacgatcccgtgttcatgcatgataggcattaaggcttcgattgggttgagaatcccagttgtcgtttcgctatgaacggttgcgaagtgggtaatctccggatggtcagctaaggttgcttcaatccgaaccggatcgacggcttcatcttcgttgaacacaacgtcgatatgtggaatatcgtaatattctgcgatttgactgattcgatgcccatatgcgccgttaatggcaatcattaaagttgcatcggtccgtggtactgctgtgccaatggtggcctcaacaccaaaactgccgcttccttgtagtaggacggtcgtatagttttctggattggcttgggccatagctaagatttgttgccgaatggtttcggtgacgtgccgatagtcactatcccaagtacaataatcaatttgcattgcgtccttaacactggcagtcgtactgagtggaccgggtgttaggagtaaataaggttgtttcataaaaatcgggctccttgtctgctaatgatcagtggcaaccggttgattgatttgatcaagcaatgccggtaattcagccatcgattgtaaaatgtaatcggcaccagcgcgttgataagcggcagtgacgtgggctcgtcgttcagcttgttcggcggggctaagggcgttgaaggctaactcagaaagtcccatgatgttgctaccatcaataatccctacagagactgcgtcggcgttgttgccttctaagatatcattaacggaatccccaattttcatgacggttgttggatcggtgattgtgagctgttcagctgctaacgcaagcattgccggcgctggtcgaccaacaccaccagtttgttctgaagtgatgttgacggcgggacgatagccttgcttagctgcaatcggtaagaccagagctaacatttcagcgtcatagccggtggtcgtgccatagctgatattgtgagcggtcaaatagtcaattacagctgacatgccgggctttaattgtccgaattcagtcagggagctaagcaagattgccttgaagttgctaaagatttgattgcagtcgtcttcagtcggtaagacttggaaacgcgcctgccagtcgttttgaacggccggtaaatccatgattttatggatatgggtgtacttatctagtcccatatcttggcgaatctcagcttcagagatttgaataccaacgttggcaaaggctttttggaaagccacgatgggcgcccggctgccatagtcaatggtcgtgccggcccagtcaaaaattactgctttaattgtcattgatgaaaactcctttgaatttacttagttgttctttaagtagtggccacgtaaccgcatagaaaccagttcgagcacgattgcgacacccaagagtaggtagacaatcaaaccaacttcatggaaatcgaagtagaaactgccagccatgaagaggtagtaaccgatatcgtcagcaccggctgcagcaccaacggcgaccgcattggcaaagttaatttcaaaccggatgaacgtccagctaagaagtgctggaatgattgacgggagaatggcctgaaaaacaatcggccaaaaacccacgccactcgcctttaacgcttcaatcgtatcttgtgaggtttcttcaatactttcagaataagccttaaccaagtacgctacactgtggaaggtcaagccgaccacggcggcactagcacctaatcccatgactacggagtaaattaacacccataaaatcgttggaatggcacgaataaaggccatgactgctttaatactagtagctaaccaactgggtgctaagttacgggcagcaccgacggcaatgaagaaggcgattagcgctcctaacaaagtcgtcaacattgctaatgaaacactagtcattagggcccgtaagagtttccccagtgtgtcttgaccaacgctagggtgtaagaacatagcattcaggttgagacctaagctatgcaaagcgtcaatgatgttcaggttggcattattgagtgtgactaatgaatagacactgataagcgttaggccaatcataacggctcgcaggattttgcggggccgagtcaccaacgaaatcgaccgggttggtggtgctgacggttgaagtacttgtgttttgggttgactgttttcaatcatgcaattgccctccgaattcgattagatgtcaattctaaaacaatgactaaaatcgcaattaacaaaacaattagaccagcagcgtcatagcggaacgccttaaaatagtagtcaaagagaaaaccaacacccgtacccgtcaagagtccgaccaaggttgcgtcccgtaagttgttttcaatcatgtagagaatccaactagtcaaggtactagcggcttcgggtaacaccccacagaagacacattggaaatagttggccccaacggcttgcagtgcttgaagcttttcggcatcgaggtcctcaatagtttcagtaaaggcccgtgttagatagcctagcgtcataaagaacagtgccaagaagcccgtaaagtcactctgtttaaaagaaaacagaagaatcatcgcccaagcgaccaccggaatattacgtaagagtgaagcaccaaaacgaataatccagcggaggacaggctttggggtggtcgtcttagcaccgagaatcgcaaagatcagggcgaagagactagcgaccatggttgatgaaattgccacgagcaaggtccgccacagctgataaagaatcggtcccagataagaaatcgaacgacttgtcggaataaagttggtaaacaaccacattaagcccgctggaatcttactgattgaagcccacgcctgaaaattaacgagggccatggataagacgtagatgccaattaaaatgagcaaaacaactgataatcgcaaccgacgttgccgaaaaaagcgttgcggtgtcattggattagttttcattggcagccaccgccgttgattggtcaggttggcgataaatgtgttgtaagaccgcgtcgtcaacttcattagtggcgccttcgaaagcgatggcgccgctgttaatgccgacgatatggtcggtgtacgccattgcgatatcgacctgatgtagattaatgaggataatcagttgtttttcctttgccaatcgccgtagaatgtccatgacaatggtcgttgatttgggatctagggaagcaatcggttcatcacataaaatcatcttaggatgttgcattaatgcccgtgcgatcccgacccgttgttgttggccaccacttaattgatcgcaacgttggtaggcgtattcttttaaccctacttcgtcgagtagttgtagcgcctcttgtttttcggcgctactgtaaaggccgagcatgccagcaactgttgatttagcgcctaagcggccatgcagaacattttcaagggccgttaacggactgatcagattgtagttttggaaaatcatgccgatatgatgacgaactttgcgtaattcagctttgttcgcttgacgaatgtcagtgtcatcgagcaaaatttgaccactatcatcgcggatcaactgattgatactccgtaaaatagttgttttaccagcaccagacgggccgatgatggcagttacttcgcccggtttagctgtgaagttgactgctttgagcgaatgcttattggaaccatatgttttatctagctgaataaccttgagcattggcaaatcctttcattgtgaactaatggtacgtggtttagtaacctactaacttatgcgttggcgcgtaccacttgtcggtaacattaactaatttggacttttctgatttcttagggaacatcattggtgtcttcgcatttggttcagagaagatctttttgttttgggcaaaggacttcgacgtgaactcagtggcgatcttcttttgatcatccttgctgagggccttggtattatatacccatgggccttgttgaacaggcatcatggcaatgttaacgaccgacttgccggctaaacttgtaaatggcgcttcggcgttatccttaacagtgaaagttgagccgaccttgtcccatgatcccttggtaacgtttaagtatggcattaaatcagcatcatcaaaggcagcgacatccgcatcccccttgattaagttgaccgcggaaccctgatgagagccaccatagagcactttactaaagaatgatccgctttgagttaatttatcttggtcagcggttttgatgttgaattcacgtgagatttcagccgttggtactaagaagcctgaagttgaactattggaaacataagacatcttcttgcctttgacgttcttaatactgtacttaccgttttcttcatactttttggcatctttttgttgtaccattaagtaggagttataagtagcgtctttcaaggtacctttagcatcagattgtgcggcaaaaggtacaacatctttgctcttgtggtgtgcttggatataaccgttagcccccatgtatgcgacttgagctttgccggatgcaattgcttggatcgcaacgttatagtcggtcgtggtttgtaatttaaccgtcttacccgttgccttttcaactgcttgcttaatggccgtacgggaaccagcaaaactcttggctgattcgttaggatagaagaccaccgtgatggttttgctgctatccgtactgctactaccagatttagcactggttccgctagcgcaacctgcgagtcctaaacctaaaaccgaaatgaatgaaagacctaataatgacttactaacttttgacatagtttccaattacctccaagtaattttagttacttgtgtagcataacaaggtattgtaaatgtgcggacaaggattagtgaagtatatgtataagttatgtaaataatatttacattcggttttcaattcagcgattggtaagtatgagtggaaactggtcaggatagttgttgattgtttctggattgaattggttggttactaccgtaaagctttcaaagtaagtaaattatgataagatatgtgaagtaattcaaaatgaggagttttttaaaattatgaagttgttggcgattgatacttcgaatcggccattgagtgtcgcggtattagaagatacccagatcttggccacaacgaccactaatgttggccgtaaccacagtagtacattattaccgattattgaacaagccatggctcaagctaaattggcaccagctgatttagaccggatcgtcgttgctgccggaccagggtcgtatacggggttgcgaattggcgtgacgactgctaaaacacttgcctttacattagataaagccttagttggtgtatcgagtttggccgtgttagctggcaacattgtgacggaaggccaattagtggcgccgttatttgatgcgcgtcgtgacaacatctttgccgggttatatcggattaagaaccagcgtccagttgccgttatcgctgatcaacatatcagtgtgaccgagtggggccaacgattagctagttatgatgaaccaattacctttgtcggcgcggatgtcgatcaatatgcggatgctttgcagcaatcgttagccaagcagttcgttcgtgcagccccacaacttgacttgccccaagccgtagtactaggtttgatgggtcgaacgctgacacccgtgagtgaaattcataactttgtgccgaactatttgcgtttaacgcaagctgaacgtgattggcaagccaagcacccagaaaaggaacatgcgccctatgttgagaaaatttaaggagtactttcaaaaaatgaccaccggtggcaatcaacgccgccaacgtgtactggccattcaaaatcacatcgttaaagtgggcgaagtcaattactatgtctcacgcgcactgattaccgatgtgcccgagatgctagccattgaacgggccgtatatgcgggacagacaccgtgggatgaaaatgcgtttaagacggaacttcgccgacagagcggtcgtttctatattgtgatgcgtcatgaagatcgcctcgtcgctttttgtggttgtgtctttgatgatcgccgccaagatgcacatatcaccaatattgctgtacatcctgatgttcaaggccaaggactaggccattttatgatgcaagtcatgatgaagcgggcgcgtaagttgcattaccaaacggtgacccttgaggttcgttacagtaatacgattgcgcaacaactttaccgcgatttagggtttgaaaagactggtatcaagaaacggtactattttggcgaccatgaagatgctattgatatgacttatcgtattccggtagctacggatgactgaacgacagcttgtcgccagtacgcagcttgacgcgggtcgggccgtccaagtttgttaccagttagcgacattagcatatcccggtggcgcaccttggcggcaagcgacgtttgcggcggacatggcgttaccaacggtacactatgatttattacggtggcaggatgaactgatcgggtttgtcagccgctcaacagtgcttgatgagaccgaaattacgaatattgcaattgatccggcctatcagcgtcaagggcatgcgcggtggttattaacagcctgcttagcacaattatcggcagggtccgtattcctagaagtccgggctagtaatctcgccgctcagcgcttgtatcagcaatgcggctttgaccagattgccacgcgtaaggaatattatcatgatcccgaagaagatgcgtggatcatgcgtaaaatgattaattaaaaggatgggaaccgtggaaaaacaaaacttgattttagcgtttgagtccagttgtgacgagactagtgtggcagtgatcaaagatggccatgagattttatccaacgtgattgcaacgcagattaatagtcacaaacggtttggtggcgtggttcctgaagttgccagccgtcatcatattgaacaaattacaatttgtattgaagccgcacttcaagaggcacacgtgacgtatgctgaccttgatgctgttgccgtgacgtatggccccggtctagtgggggcactgttagtcggtgttaatgcagctaagacagtggcatacgcgcaccaattaccgctgattccagttaaccatatggccgggcacatttatgccgctcggtttgttaagccattcgaatttccgctaatggcactattagtttctggcggtcatactgaattggtctacatgcaagcagatgggcagtttgagattattggtgagacacgtgacgatgcggctggtgaagcttatgataaaatcggtcgggtattgggtgttccatatccggcaggtaaagtcattgacgagatggcacatgcaggtcacgacactttcaaatttccgcgagcaatgattgatgaagataattacgattttagttttagtgggctgaagagtgcgttcatcaatacggtccatcacgcagatcaaattggcgcgactctggataagaacgatttagcagctagctttcaggccagcgtggttgatgttctgatgagtaaaacgttacgagtcctcaaacaatatccagttaagcaattagtcttagccggtggcgttgcagctaatcaggggctacgtgaacggttacaacaagatttaccaaccgcttttcctgacaccgaactaatcttagcgcctctaaagttatgcggtgataatggtgccatgattggtgctgcgggctatgttcaatatcagcatcaccaattcggcgacgcggcgctgaatgccgatccaagcttagaatttgattggatgccaggtatgttgaagtaatgaagcagttataaacgggtgtgaaaagtcagtccttttcacacccgttttagtatcttttcattaattatgattgaaaggtgccggttaggtggattcctgttcgtcagcaatgcgcgtccgattccgacctccggggctgggtgccaattgctggaacgcagccgacgtcgatttgagctaacgcataacccgcgtcatctcaaatacgagtcttattctaagccggaagcaacccacttccagctaagaataatttggctactgagcattgtcacccagcccctccggtctcaagcctgtgaggggtcacgggttgaagccgagcattgcctagccaacggattaatgcggttttggcattagtccgttggcgtagcacgcacaggcttcagtggtaccgagcacatttcggaaacccgctcgaatggctgataaacggccacttaacttggtgcaattggtcgtcgactattttaatactggaaccttaagtacaatatcactctcagtctgacagttgattgacaaaattaccgtttttgaaaagcaatggccaatttatcaaaagttgggtacctcaccgtctgccattcgaatactatcccgactggaaggcgtttctgacaatgcccagtggtgaaatttcacttaacaagcgtcctttgcttggttagtgaaaggccagtatttgagacgtggtgtttcggctcaaatctgtgcccaccacgttccggcaattggcagaaatgcctggaggtcggtgtaggacgaactaactaagcaagtttacactaacttgaactatttccagcgggcttaagctggtcatttttgattctaggaatcatcctcttttaatcatgatttatgccgcggataggggcaaaataatagtcgcctcaagaattatattaattcttgaggcgactattatttttatctaatgagtcgttggaaaattagctcaattcttctaaagcttcagcttgttcggtccattcggtttcaacttgttcttgttgagtattgatggcttcaagttctttttgtaggtcttgtagtttaccaacatcggccgatacttcaggttgcgccatttcagtttgaatctgtgtggcttgttcatctaaggcagtcatctgttcttccagggcggcaactgagcgctcgagcttgcgcttttcacgttgttgctgcttgctggcttggtaattttgctggcccttggagcggggagcagcagttgtggcactggttgaatccgctgcaccggcttcagcagctttttcggccgcttggctagcagccgcagccgcgatttcagcttgctcttgtttcttgtcgatgtagtagtcgtaatcacctaagaagagttccgtgccttccggagaaacctctacgacactcgtggcgacttggttaatgaagtagcggtcatgtgacacgaacaaaagggtgccgtcaaagtcgttgagggcgacttccaaaacttcacggctatcgatatccaagtggttagttggttcatctaagattaagaagttgtcattttgcatggcaagtttggtcaacagtaaccgggctcgttctccaccagatagggcatgaacggatttatcaacatcttcaccagtgaagagaaaactgcccaaaatggtacgaatgtctttttcaggagtggtgggatgttcatcccaaagttcactgaggacggtttttttgtcgtttaaattacgttgctcttgatcgtagtagcccgtaacgacgttggtgccaaaaacggcctggcctttaatgaatggaatctgtcccaaaatactctttaggaaagtcgatttcccaataccgttcggtccaacgatggcaatagcttcatgtttcttaatattcaagttgtcgggttccgaaagaatctgaccatcatagcccacggctgcatctttgacggtcaacacaatgttgccgctttgtttagccgcatgaaagccaaagtgggcagtcttctcgtcactatcagggcggtcaaggcggtccatctttgctaactgcttacgccgagcctgggcccgttttgtcgtagaagcacgcacgatgttacgattaacaaagtcttcaagcttgctgatctccgcttgttgcttttcataatgtttccattgtgcttggattcgagccgctttttcttgcacaaactggtcgtagttgccagtgtagtgcaccatttcatggtgtgataagtcatagacttcgttaacgacccggtctaagaaatagcggtcatggctaacgattagcagcgcaccagagtaagactggagatagctttccaaccaagtaagggtttcgacgtccaagtggttcgtcggttcgtcaaggataagcaagtcccgtttttcaagtaacaacttggccaaggccaactgggtcttttgtccaccggatagtgccgtcaccgacttatcgtacacatcggcgtcgaattggaagccgtgcaacacgccccgaatctcagcttggtagccgtacccgtttttttgttgaaattcagtttgaatctgatcataggttttcagggtctgttgataagcctgctcatcattcatgattgcggggtcgctcaattgattttcgagctggtgcatccgtttttcgatggcatgtaactcagcaaagacactactcatttcttcccaaatcgtattgttactatccagtccttggtcttgagccaagtaaccgatcgttaagcccttgcgcattgaaatctggccttcgtccggtaccgtttcgccggcaatcattttaagtaaggttgattttccggccccgtttcgaccgacgagggctacccgggcgtgttcttgaatatccatttgtacgttatcgaacaagacatcggcgccaaaacgccgcataacttgctgtacttgtagtaaaatcacgctttattaagctcctttcacatttaattcgtgacataattgtagcatattgtaacggcctgacccaattattcggaataataagtaattattatttcacaaagtcacgcgttatgctagaatagtgtcagcaaattcacaaacttttaattaggaggacacgtccgaatggcagaaacaaaaattccacgggcaacggcaaaacggttaccgatttattaccgctacttaaatatcttgctagatgcagataagaagcgggtctcatcgaccgagttgtccgaggcggttaaagtagattcagcaacgattcggcgagatttctcgtattttggggcgctcggcaaacgagggtatggatacgatgttgaaacgttacttgcatttttcaaaaagattttaaatcaagacaccttaacgaatgttgctttaattggggtcggtaatttgggccacgccctactgaactttaattttcacaaaaacagtaatgtccgcatctcagcagcatttgatgtcaacgaggcgattgccaatacagtccaaagtggggttccagtgtacccaatgacggagctcaaaaagcaattgatcgaacaacagattgagattgctatcttaacggtgccaaccacggttgttcagaaaattaccgatgacttggttgatgcaaacgtcaaaggaatcatgaactttacgccgttacgaatctccgttcctgagacagtacgggttcagaacgttgatttgaccaacgaattacaaacattgatctacttcattgaacattacggtcagcaattaggtgacaatggtaatgacgatgaaaatgagactgaagattaataactcgctttatctttgaaattaaatggctataaaaaggcctctctgaattattcagggaagcctttttaacatacttagatcacgaatcattgattgtaacgtataaatattcggtgaaaattaacgttgaaacgctaggttagcgctacctagtaatgatactagtgcagtaagcctaataatgtgggtaacacaaccgatgcgttcattaggatgtgagccgtcatcgatgtttgaatccgaccggtgtgctggtataaccagcagaataataacccgataaaggcatagaggataaagtgaccatccgcatgtgcaaagctaaatagcacactagaaatcaaggccgccccaatctgaccagtaaccgcacttagattgccaaagataactttgcggaagacgatttcttccataatcggggcaccgacaatgatggctaagaagaaagcgggatattgttgcccaacagttaagagggtggtcgtgttggttgacgctgttgactgtcccagtaaagccgtcatttttaaaatgatgacttgaccaacgatgactaggacaagaccaatcaatccccagatgaacgtcatgaaccagttacttggttgtttttcaacaacgttttttgtccgcatgcgactcgccaaccagatgagtaggattgcaccgactaagtagtcgaccgtttgaatcacgaatacttgggaccctagctgatggaaagcagtcacaaggacgctcggtagtgcgtaaataataaagtagatgataagaataaagattgattggcggcgattaaccatcaagtcacgtccttttaaaagtttgatttaagatttattgatacttcaatagtattcattatagtcgatttgacattctttgactaataattgacaaatcacttgcaatcttgaattaaaatgatatagttgacaatgtaattagcacttgaggttgaggagtgctaaaaaagaataaatggagggattcacgtgttaaaaccattaggagatcgcgttatcttgcaacaacaagaagaagaagaacaaacaattggcggtattgtcattgccaataacgctaaggaaaagccccaaagcggtaaggttgttgccgtcaatgacggtcgtgttttagataacgggacaaaagttgaccccagcgtgaaggtcggcgatcaagtattattcgataagtatgccggtaccgaagtcaagtatcaaggtgctaagtatttggtattgcacgaaaaagatatcgttgcaatcgaagactaatccatttaaattgcgcaacttaaaataaattaaattcatgaggtgaatagagataatggctaaagaattaaagttctctgaagatgcacgttcagcgatgctaaaaggtgtcgatcaattagctgacacagttaagtcaacgttaggtcctaagggtcgcaacgttgttttggaacaatcatatggttcaccaacaattactaatgatggtgtaacgattgctaaggcgatcgaattagacgatcatttcgaaaacatgggtgctaagttagtttctgaagttgcttcaaagactaatgacatcgctggtgatgggacgactactgcaacggtcttaacacaatcaatcgttaatgaaggtatgaagaacgttacggccggtgctaaccctgttggcattcgtcgtgggattgaagaagctactaagacggcggttgactcattacacgctatggcacacgaagttaagacgcaagaagatattgcgcaaatcgcttctgtatcttcagcaagtgaagaaactggtaaattgattgccgaagccatggaaaaagttggtcatgacggtgttatcacgattgaagaatcacgtggtgttgatactagcttagacgttgttgaagggatgcaattcgaccgcggctacttatcacaatacatggttactgataatgataagatggaagcggatcttgacaatccatatatcttaattactgataagaagatttcaaacattcaagatatcttaccactattacaatccatcgttgaacaaggcaagccattgttgatcattgctgatgacatttctggtgaagctttaccaaccttagtcttgaacaagatgcgtgggacgtttaacgttgtcgccgttaaggcacccggttttggtgatcggcgtaaggaacaattacaagatatcgctatcttaactggcgggacggttatcactgacgaccttggccttgaattgaaggacacgaccatcgatcaattaggtcaagccaacaaagttacggttactaaggataacaccaccattgttgaaggcgctggttccaaggatgctatctcagaacgggttgaatttatccgtaaccaaatcggtgaaacaacttctgactttgacaaagaaaagttacaagaacgtttagctaaattagctggtggggttgccgttgttcgtgtcggtgccgctactgaaactgaattgaaggaacgtaaataccggattgaagatgctttgaacgcaactcgggccgccgttgaagaaggctttgttgctggtggtggtactgctttgattaacgttatcaaagatgttgctgcattgaaggaaactggtgacgttcaaactgggatcaacattgttaaacgtgctttggaagaaccagttcgccaaatcgctgaaaatgctggtttggaaggctctgttatcgttgaaaagatgaaggaacaaaagccaggtgttggtttcaacgccgcaactgatgaatgggttgacatgatcaaagctggtatcgtggacccaactaaggtaacgcgttctgctttacaaaatgccgcttctgtttcagcccttctcttaacgactgaagccgttgtcgctgaaaaacctgaagaaaatgcaccagctgcaccagccgcaccaaacccaggtatgggcggtatgatgtaaacaaatcgtaacattaagcacttactcggctgagtaagtgcttttttagtgctgttagggtgtgaatcgactagaataaaggtattgatttatccatattagagcggtaggattagtcgttaacgcaaaatgtgggtgcggtgaagcacccgacatttaactggtagtatttggcagggtaaagtagtagaatctactttgactcagtttactttgggataattattttggaataaaggagttattatcatgtggcgttatttaaagcggttagttattgggaaaccgttaaaaaccatggacgagggtgggcaagcactcaccaagttcaaggcactggcgctgctatcgtcagatgcgctatcatcggtggcttacggtactgaacagattacgaccgttttgattacactttcagcggccgcgttgatgtatcaattgtacgtggcggcgcttgtgttagtgctgttgtttgctattacgatgtcgtaccgacaaattattcgggcttatccatctggcggtggcgcctacgtggtggcaagtacgaactgggggcggccagccggattagttgccgggggatcactgctggttgattatatgctgaccgtagcggtttccgtcacttctggtactgaagcaatcacgtcggcgattccggcgctagctaattatcaagtattgattgccgtactgattgtcatcgccatcatggcgttaaatttgcgtggaatgcgcgaatccgcatcattcttaacgtttcccgtttattttttcattattatgattatcggcatgattctatggggcgttatgaatattgcgagtggtaacttaacttaccacgcctccgcagcagttggagcaccggttcaagggatgaccttggtgctgttcttacgggccttttcttccggttcgtcttcgctgactggggtggaagcaatcagtaatgcggtgccaaacttcaaacgaccgaaacgcaagaatgcggcgaacacgttagcaattatgtcattagtcttggccgtcttctttggtggtattacttatttaagttattacttaggcattaaaccacaagtagacaataccgtcttgtcacaaattgctacggcggtctttggtcacggcttattctactacttgttacaattatcgacggcgttaattctggccgttgcggcaaatactggtttttcagcctttccaattttagcttataacttggctaaagataaatttctaccacatgcttacatggatcgtggggaccgcttgggctactccaatgggattatctcattggcggtcggggcaattgcgttgatctttatctttcatgggaagacgacgcttttgattccactttatgcggtgggggtctttgtcccatttactttgtcgcaatctggtatgattattcattggttccgcgaacgggggcaatggtggtggatgaaggcggcggtaaacttacttggggcgttgatttcgattctcctagtgattttcctattcttgctacatttcggcaatgtttggccatacttaatcgttatgccactcttactgtacatgttctaccgaatccacgtgcactataaccgggttgcggcccagttacgcgtggttgccaaggaaaaagcggcgattcatgattatgacggtgcaacggtgatcgtcctcgtctcgaatgtgacgcgggtaactgctcaagcagtcaactacgcgcgatccatcggagattacgtcattgcgatgcacgtgtcctttgatgagaaccctgaaaaggaacacaagacggcggcagagttcaaagagaccttcccagacgtccgtttcgtggacatccattcgtcgtatcggtcgattgcaacaccgacgttacgattctgcgatgtgattgctaaacgagcagcggaacgcaacttctcgacaacggttcttgtcccacaattcgtgccgaagaaaccatggcagaatattttgcataatcaaacgagtctccgattacgagcggtattaaattctcgtgaaaatattattgtttcaacttataattaccatttaaaagaatagtgacttagtattgaaacccggtatagccaccgggtttttatttttgtgtcataatatgagtaactaaggttataatttagatacttaatcagcccagtgaccggcaaatgtgaacgaattgtgttgcctttactaagttttagtgaagcgagttgtcaagcgtcactgggatttgtataattatcgtaatagagtgagaagggagttacgcacaaatgatcagatttgaaatcctagtaagcctagtggcgaccatgatactttctgcgatcttgacgccgtttgtgcggaaacttgcatttaaaattggtgccgtggataaaccaaatgtacgacgggtcaataaaattccaatgccgacaatgggaggcttggctatttttatctcttacaccgttgggacgactgtgttgtatctcatgcaccagtttcccagtcgcatttttttcgcactactcggtggtgagctgatcattattgcgactggtgttatcgatgatatttatgagctaaaaccacggcaaaaaatgttagggattacgttagccgctttggaggtctactttattggtggtatccgaatgacgaccttcacgttcccgttgctggggctgattcactttcagtggctgagtttaccggtgactttactgtggatactggctatcacgaacgcggtgaacttaattgatggactggatgggctagctaccggtgtttcgattatttcgttgagtaccatggggatcatcgggttgttcttcttgaatgctaatatgttcgtttcgttgttgatttttactttagttgcggcgatgattggctttcttccgtataatttctttccagctagaatttatctcggtgataccggttcgttgtttatcggctttatgacggctgtgttctcattatttggattgaaaaatgtcaccttaatctcagttggtattccggttatgatcctgggagtgccaattacggatacggtgtatgcgatgattcgacggatcctgaataagaagcccatttcgcaagcggataagcatcatttgcaccaccgcttgatgcaattaggattgacccatcgacagactgtgatggtaatttatgggattgcacttattttctcatttatttcattgctctatccgatctcatctatttggggttctgtgttattgacgattggtttattatttgggctagagttattcgttgaagcaatcggattagctggtgacaatcggcaaccgctactggattggatcaaacggaccgtcgcgcgtttgacctccaagagtaatcattaaaaaccaaataaatcattgaaaattattaaagtgttacaggcatctaccgtgtgattagcggtgatgcctgtttttagttggtcatcagttggttcatcaatcttaactttaccaaaactatacaagcaatttacacaatcgtcattcacaatttacaaacgattagtaatattaagcatgttccgaagcaatcaattacgtgtaaccgtcggacggtgatgttgctccatcactagtcgtagcactcctacccagttttgctatgatggttgccgggttggttgcttaattttgatagtcaattgaagaaggggagtttcaattatgaaaaaagcactgacactcggcgcattggcagtaacgatgaccattttactagctggttgcggcagtagctcagccacaagtacgaagagtactagtagcagtagtggtagttccaagactactaagatcgttgcaactggttcaaccgctttacaaccattagtggaacaggctggacaggcttaccagaacgaacatgctaacgtgaccattaacgttcagggtggtggttcaggagcaggcttaagtcaggtggcgaagggttcagtcaatattgggaactctgatttatttgcacaggaacaaaaggggttagacgccaaagggttagttgaccataaagtggctgttgtggggatggcacccgttattaataaggatgccggtgtcactaatatttcaaaagaacaacttatcaagattttccaaggcaagatcactaactggaaagatgttggcggtaaggacaaaaagattaccgtcgttaatcgtgctcaaggtagtgggacccgggcgacgtttgaaaaatggggattagacaacgcgaaggtcgcaactagccaagaacaagattcgaatgggaccgttcaaaaaattgttagcaccacgcctggtgccatcagttacttagcattctcatacgttaagagtgacgttcaggcgctttctattgataacgtcaaaccaaccgaagctaacgtagcgacgaacaagtggaagatttgggcttatgaacacatgtatactaaggggcaaccaactggggagttgaagaacttcttaacttacatgacttctaaagccgttcaaggtagtttagttgagaaattaggatatattccattgacttcgatgaaggttgatcgtggccaatctggtgcaatcactaatttaaaataaataacagacaaaaagtcgagcgatagctcgactttttttatgggccgcaattagtgcaacgcggactttaacaatgaaaaaacaaatcatcggctcaagtgctgggtgttattgttaagacgagttggctgtttcgattttgactgccaatcaaagtttgtgaggctcccaattatatataaccagcaatctagttgccaggcgtagtgaccggaatttctgtaaattgttcaccttgctccgaaaaggtaacttgaccgctcaagaggttagtgatgtcctgctgaatcgttgcaatttcggattgagtgactgcgatgatttgtgtgacttgaacaccgtagtcggtattcagagtcgttagcttattttgttgtaaatagtaggttaaagcatcgacgttacgatagtcgagcgtgatggcgatgcgggtttgtaagattcgctgaaccttaccactgacttcaattgcttgcgcgggggtgccattataagctcggatcagtccaccggcgccaagcttgataccaccaaaataacgggtcacgaccgcaagcacgtcgtgtagctcgttggtcttgagcacttctaagattggtgagcccgcagttccgaccggttcaccgtcatcactcatccgctgaatatgatcatcatcaccaagcatgtaggcgaaacagttgtggttggccttaggattatctgctcgaacagcggcaatcttagcttgagcatccacttcgtcactgatgcggtatagatgagcgatgaagcgagactttttgatggtttgttcaaataccgtgtcttgggtgatggtgtagtagggtttagtcaaattaatcgtttcctttcgtgaataaatcgttaaatggcgtacttgataactaaggaggtgcgcacgatggaagcacaagtcttatacggtcgtcagctcgcagtatctgcaaatgaggctgccgcagtacctgctggcacgcagatactgccagccatgcaggttgatgaacatcaaattatctgtcagcgttgcggcagtcacttggaccgactgcgagcccaattacccaatcagcaatattactgttatcaatgtttaaatttaggtcgagtgagtacactagttaaactctatcatatgccagaaccgaatgcttttgcaacggtcccggtttgcacgtggcaaggaaccctaacgccccagcaagcggactgcgcgcaatcaatcaaagctaacttcatggcgcataaacggcaattattatgggcggtgacgagagctggaaaaactgaaatgctgtttccaggtattgcgtgggcgttagcgcatcagtggcgggtcgccattgcttcaccacgagtcgatgtttgcttagagttagcaccccggctccaggcggcctttgctgatgttcaaattgctgtgctacatggccgcaatcccgatccctatcagtatacgcagctgacgatttgtacgacgcatcaattgctacgttttcgtcaggcgtttgacgtattgatcattgatgaagttgacgcgtttccgtttgctgccaatccccgtttggcgtttgcagtgaatcaggcagctaaggtggagggggccattctttatttgatcgcgacgcccagccaaagtttgttgtcccaagttcatcgtggtgagcttgcaatcagttatttaccattgcggtttcaccaacatttattaccggcaattaaggttaagctacagccaaattgggctcggctgttgcaacaaggaaaattaccacgagaccttatccggcaactccaacagtatcaacaacagcaccagcgctttttactatttgtcccgcgcatccaacaattagcgccagtgtttgcggtactccaacactattttccccatatgaccggagagacggtgtactcagccgatcctgagcgactgactaaggttcaacaaatgcggaaccagcagtttcaatacttagttacgacgacgatattggaacgaggggtgacgtttccgggaatcgatgtgattgtgcttggtgcggacgacgaagtgttttctacggcggccctcgtccagattgcaggacgggtcggacgcagcagtgagcgtccgactggcctcgtctggtttatttgtcacagtcatagccgcaatatcaaacgcgctcagcgccagattcgggtgatcaatcgaaaggggcgacaattacgtgctagcatgcctactgtgtcacaacattatcacgactaggtttacgttgccctggattcttagttggcagccggttatgcggccggtcgtctgctcggtttgttggcggcaatttgtacgcatcgatcgggcaacggcatgttccaaatgtggacgtgctcaaaaacgaccacaaccgtgtacagattgtcagcggtggcctgaaatcggtccctttcataacgaggcgttgttcgaatataatgatgcgatgcatgattattttcaacgctataaatttcagggtgattatcaattacgccaagtttttgcgaagatcatgcaacaagcagtggtacaacggtgtgctgagatatgcttagtggtacctgtcacgcccacaacgttgcaaacacggggctttaatcaagttgccggctggttagccgcacccctcgcacccgggttaatgacccaggcaacagcgaagtcagtgccacaatctaagaaagaccggcaagcgcggttgagaacaccacaaccattcaagatggctcctaatacgattttggccggccggcgggtattattagtagatgacatctatactaccggccgaacgatgcgccacgcggcaacgctacttttggaaaacggtgccaagagcgtgacggggctaacactagcacgttaatttcgagggaaagtggtatttggattgtttattatagcgctttctattataatgaatttaagcaaagtaattaaagagtggtcctttaattactttgggtacacagcaatgtgtgtgaagggagagaagatctatgctaaattttaatattcgcggtgaaaatatcgaagtgacccaagcaattcgggactacgttcaaaaacgggtgggtaagttacagaagtactttgacaataatgttgactcaattgcccatgtcaacttaaaagttcacccagacaagacggctaaagtcgaagtcaccattccacttccctatttagttctccgggcagaagaaacttctcctgatatgtatgctagtgttgatttggttactgacaagttggaacgccaaatccgcaagtataaaactaaggttaaccgcaaatcccgtgaaaagggttataaagcgattgattttgcagcgactgatgaaacagttgccgctgccgacaatgatcaggacgataagttagacgttgtacgtacgaagcgagtggctttaaagccaatggataatgaagaagcgattctgcaaatggatatgctcggccatgacttctttatctacgaagacgcggaaacggacgcaattaacatcgtctatcggcgtaacgatggtcgttacggtttgattgaaaccgacgacaatcactaattttaaaagcgcaacttatgaggactggtcagttgaccagttctttatttttatcccggaacgcccgtataacatattgtgatcatgagagtgacttagcccgcgttagtaagctgaagttcgactcacggcacgtttttgccagcgactcaagacagttaagcaaatattgatagaattaaagaacacgggtcagtgattgttgggctgtggttaaagactaatatttagttaaggatgtaaataaaacggtcgacggtatcggttacataggggcctgtggttttcattgctagtaaataatggtaaaatgacagatggtattttattttgaaatggacaattgaaattaaaattaagattaattatttggagaggatacgtaaatggccaacattttaaaacgctgggttgaaagcgacaagcggactattcggcgtctggataagattgctaataaagttgaagcttatgccgacgaatacggcaagttaagtgatgctgacttgcaagcgaagaccccagaatttcgtgaacggtacaaggagggcgaatcgctcgacgatttgctgcccgaagcatttgcaacggcgcgtgaaggtgcgaagcgggtacttggtttatacccattccacgttcaaatcctcggtggaatcgttttgcatcaaggtgacattgctgaaatgaagactggtgaagggaagaccttaacggccactatgccagtttatttgaatgccatctctggtaagggtgttcacgttgtaacagttaatgaatacttatcagcgcgtgatgcgactgaaatgggtgaactgtataactggttagggatgagcgtcggaatcaacggggctgaaaagtcgcctgaagaaaaacgtgccgcttataacgccgatattacttattcgacgaacggtgaaattgggttcgactacttacgtgataacatggtggtctaccgtgaagacatggtgcaacgaccacttaattttgccatcattgatgaagttgactcaatcctgattgatgaagcccggacaccgttgatcatttctggtcaatcagaaggtacaacgggaatgtataagcgggctgaccgttttgctaagacgttgacgaaggatgaagattacaaggttgacttggaatctaagacggtcgcattattagacgaagggattcggaaggctgaaaaatactttggcttggaaaacctttacgatactgataatacggcgttgaaccattacttggatgaagctttgcgtgcgaactacatcatgttgaaagataaagactacgtgatttcagacggtcaggcgttgatcgttgattcctttacggggcggatcatggatggtcggcgcttctcagacgggttacaccaagcaattgaagctaaggaacacgttgagattcaagaagaaaccaagacgatggcgaatatcacgtaccaaaacttattccggatgtacaaaaagttatctgggatgactgggacggccaagacggaacaagaagaattccgcgaaatctataacatggaagttattacgattccaacaaaccgcccgatgattcgtgatgaccgttcagatttgctttacccaacgttacaaagcaaattcaacgcggtcgttaaagaaatcaaacaactccatgaaaagggccaaccaatgttaattgggaccgttgccgtggaaacgtcagaatacttgtcgcatcgtttggatgaggaaaacattccgcacgtggtcttgaacgccaagaaccatgcgaaggaagctgacattgttgcaaacgccggtcaacgtggtgcggttaccattgccaccaacatggctggtcgggggaccgatatcaagttgggacctggtgtcaaagaagtcggggggctcgccgttattgggactgaacgtcatgagtcccgccggatcgataaccaattgcggggccgtgctggtcgtcaaggtgatcctggtatgtcacaattctacctctcacttgaagacgatttgatgctacggttcggttcagaacgaatcaagaacttcctgcaacggatgaatgttgaagatgatgatgcggttattcaatcacggatgattactcgacaggttgagtccgctcaaaaacgggttgaagggaacaactatgactcccggaagaacgttctacaatatgatgatgttatgcgggctcaacgtgaagtgatttacggcgagcggcaacaagtcattatggaagaaaaatctttaaagcccgttatcatgccaatgatcaagcggaccgttgaacggaccgttcagttacacatgcaaggcgatgccaaggactgggatttagatgcagttgttgactttgcccaagctgctatggtgaaggaagattcaattagtgtggctgacttgaaaggtaagtcgccagcagaggttgaagcttacttgatggaccgggtcgataagatttatgcggacaaggctaaacagctttacgatgcgggtcagatgctagaatttgaaaaagtcgttattctgcgagtggtcgattctcattggacggatcacattgatgcgatggatcaattacggcaatcgatcggtttacggggctatggtcaattgaatccgttagttgaatatcaacgagacggttaccagatgtttgaagaaatggttgcggatattgattatgatacgacgcgactcttcatgaagtctgaaattcgccaaaatattcagcgttaaaatttaacgttagtgctagcgagtctaagactaaggtcttaggctcgttttacagttaaaccagatattaaataattaataaataagttgaaagaagggtcctttgtggaattaagtgaatataaacacctgattgaagaaatgcaaagtgctgtcgacgactttagggggtcgctttgacttagatgctttgaacgaaagcattcaagaaaatgaagctcgaatggccgaacccggtttttgggacgaccaggctgccgcccagaaagtcatcgatgagaataacgtgttgaaaggaaagtatgatacgtttaagcaattagctgatgaagtcggtgacttggcagtcgcttatgagttactgagtgaggaacccgatgctgagatgcaggctgagtttgaaacggactttcagcacgctgaacatgatttacaacagtaccggctcaacttacttttggacggtccgtacgaccgcaataatgctattttagaaatccatcccggagctggtgggaccgaatcccaagattggggtgcgatgctactaagaatgtacacgcgctgggctgcgagtcacaatttcaaagtcgagactgttgactaccaagctggtgatgaggcaggcattaagagtgtgactttattaattagcgggcacaatgcttatggttatttgcggtcagaaaaaggggttcatcgtcttgttcggatttcgccgttcgatgcggctggtcggcgccacacatcttttgcgagtgttgatgtgatgcctgagttagatgataccgtggatgttgatattcgacctgaagatttgaagattgacgtttatcgagccagtggggccggtggacaacatgtcaacaagacttcttcagcggttcggattacccacgtgccaacgggaatcgtcgttgccagtcaagcacaacgttcacaattacagaaccgacaaacagcattgaacatgttgcgagcgaagttgtacgaacgtgaagaagagaagaaggctaaggaacgggcggccatccaaggtgagcaaatggacattgggtggggctcacaaattcgctcctacgtttttcatccgtatacgatggtcaaggatcaccggactaattatgaatcacatgatgggcaggctgtcatggatggtgatcttgatccgtttatggatgcttacttacaatggaaattagcccaacgtaatccgcaatagattgcacaaatactaaggtgacctatcattgcgcaggtcgtcttagtatttttttggctactagtcttataatatagagatattaaagcggtaatagcaggactgacggaattgaaacggcgttggtctccttgggcaaaaatgctatactaacttcagagtttaacgttaggggtcacgcacatgcaggtattaaagatttttgaattgtttcttttacaaccgctagtttggttaggattgctgcgtagttatttaaccgctaaacggcgggtgaagagtgaacggcagcattttcagagtgctatcaacccacaattagttgaagtccaccactttttagtggatggctgtttactaggagttctaatgacaattattagcttggcattgggattagtggtggcccccatctgggtggttatatacgaagtagtggcggccattagcttgatcattattcctggtgcactggtaccagtgaccgcttttggcctcagctggttagtttattggattatgagcccggaattaacgacggtggggggcgctttacaacggcacggtgttgccatgaccagtatgagtggcaatttggtggtgaacggactattgttattagccatcgtgctggcggctacggcggtcttgttacgacactatgattatgagggccgttcaccgcaactacagcccgaccaacgtggaaagcgacttgttcgttaccagtggcaacaattgttggtcttaccagttggggtactggtccccggtgattggttacacgcaactatcagttggtggcctgtgtttatggttggcgagcgctccttcagcattttattgttgcctttattagttgggacgagtgttcgcgtttataagcagctgccacaaattgcatggcggcagttagcggcccgctatggttgggtaacactcgcgagtgttttggttgcaatcattgcccgttttgcagtgctcagcccgcagtggttgctagcattgatgggattaatcgttgtgctaacttggggaatcttagcacagcaccgttatcatgatcgacaccaacagtttcgatattctgatactgaacaaggtgtgcgggtgattgggttacgcccccacacgcccgcggataaattaaatctcgatttaggagatattatcttggaatgtaaccggcaaccagttaatacggaagctgaattttacgcggccctactgaaaagtccgacgtatgttcacctcaaagtgcgcaatcggcaacaggaattaattattaccgaaacggcgatctataatggcgccccacacgagttaggaattgtgttattcactgatcaggaggattaatgaccatggataagattttagtggtagacgacgaaccagctatcgtcacgttattatcatataacttgaagcaggcggggtacgaagttgtgacggcgacggatggtgcggacgcgttgtcattaggcctggcccaatcatttacatgtattttattagatttgatgttgccgaaactcgatggaatggaagtaacaaaaaagttacgacaagaaaaggttcagacgcctattattattgtgacggctaaaaatgatgagtttgataaagtgttcggcttggaattaggtgcggacgattatataaccaagccgttttcaccccgcgaagtgctcgctcggatcaaagcagttattcggcggacaacgccggacgagcccgtgacaccaccggcacccatgccgcctgctaatcgtgcggtaatgcttgttggtgatttacagattgatcaaaacaaataccgagtcgcgcgcaacgggaaaaatatcagcttgacaccaaaggaatttgaattacttgtgtattttgttgaacgagaaggtcgggttctcagtcgtgatgcgattttaaatcacgtctggggctacgactatgctagtgagacgcggatcgttgatattcacatctcacatttacgtgaaaagattgaagcagatcccaagcagccacggttgatcaggacggtccggggctttggctacgaatttgtgggtgacggccatgcataatcgctggcaacagacgacacggttattgctcatggaaaatgtgttactggttttgatcgtgttggtcgtgttgcagtacttttcgccaattaagtggtcctggcgcctagtcggttgtttagttggtgcttggctggttttggcagtaatcgagggcttgatcgcttggcggcaacaaagtgaacggcagcgcacgatcgatcgtatggaagctaagcttcgtcagatgagtagccagcaatttccaccacatatcttattgccacaatcggaccccttatacagcctagcacaagcggtcaaccagttagagagttatcaaaaaagtcagacgcgccgtgcggaactgcaagaaaaagagttaatgatgattatgcggtacttgcctgtgggagtgatggtcattgaccaccggcgacaggttcaactgtctaatccggcgatgagtgaactattgcaagtctcggttaatacggtggcccacatttataccaaggatattcagctgtacgcgttgactaaattgattgaagatacgattactagtggcaaaaatcaacgggcaacgattacgttgactccagcgcctaacacgcaggttgtcgaggcttcaaccgtttatatccaaggcaatcgttcacaatttcaaattgtcctgatgttgtatgatatcactgaagtctatatgattgaacaaatgcaggatgattttgtcagcaacgctagccacgagttgaagacgccgattacagccatttccggtttcactgaaacgttgttaagtggtgccaaggatgatccggacacgcttgaccaattcttgcatattattgcggatgaaagtcaacggttgattgatctcattcaggatgttctgtcgctatcgcgaattcgtgctcagaatacgacgatgttaaccttagttccgcttgctgttcgaccattgatcgaacaggaactggctgtagttcagcaggcaatcgaacgtcagcacttaacgatcaataaccaagtcgatgctgatctaatgataacgagcgattcacagaagttgagtcagatcatcaaaaatctgttaacgaatgcaatcaagtataatcgacctcatggtagcgtgacgattgccaccatggtcagtcatcaaacgtggtcgctgatagttaaagatacgggcattggtatcagtgccgatgatcaacagcgtatttttgaacgcttctatcgggcgagtccgtcacgttcacagcaacttgtgagtgggactggactcggattggcgattgttcaagaattggtcaacgcaatgcacggaacaatcgacgttgtcagtcaacggggcgttgggacaactatgacagttacattgccactagctgcgagtgcttccgagcagtagtaaggcgttaagcatacggacagttctgattgtaactggtggtctatcaaatgatgacgtggtgacggtatgagttgcattgctgagtcaaaagatgtcattagttgagaattgaatgtgtcgtaatcaagccagacgaattgataacgatttttaaggtaaatgtaaaccttggaaatcgtttttttgtgcacttttttaattttcctttcatattgggggctaaaagccggtaataattaaaaatatatcgacgtttacacaatctttacaaaactcatataaagcatttacacaaactttgtattattgaatatgagcaatgggtaggaggtatatagttatgagaaaaagtcgggtcatccaattaatcgtgttaatcgcgatcattggactagttggattagggtacacacatcgcgatcaaactagtgccagtgaatcaattaccgcggttggatcaacggccttacagccactggttgaagcagccggtgaacaatacagcagcaaccataccggtgtgtttatcaatgtgcagggtggtggctctggaacgggactcagtcaaattcaggcgggggccgtggcaatcggtaattctgatatttttgccgaagaacagtctggcattacagcgagcaagttaattgatcaccgggtagccgtcgtcggtattgcccccatcgttaataaaaaggcgggcattaccaatttgacgcagcagcaactcattcagatttttacgggcaaggtcacgaattggcgtgaagttggtggacgtaatttaccgattacgttaattaaccgtgctcaaggctccggaacccggaagacatttgagcgatacgccttaaagggtaatcagagtgttgattcccaagaacaagattcgtcaggattagctcggtcaattgttgctagtacacctggcgcaattagttatgtggctttttcttacttagacaactcagtccagaccgtcaatgttgatggtattcggccaaccgaaaaaaatgtgcggaataatcgctggtacatctggtcctacgaacatttatatacggggaagcaccccaatcagttaaccaaaaaatttattgattacattttatcaaccgctgttcagcagaagttagtcaagcagttaggttatatttcggtccatgacatgcaagtacagcggaatgcggccggtaaagtttcagttatgaaatgagggagagcgcatggataaaattcgagaaagcttattaaaaaaatcagttgctagtaaaattgaacggcgtggtaaggccattagtctagtttgtctagcgctaattgtcgggattgtctttttgattttctactttgttgcatcacgggggttagcaaccttttttcaaaatcacattaatctatggcaatttctgagtgggacgcagtggaaccccggaacagtcggaacgaatgggcaaccagctgtgggggcactaccgatgattgttgggtcgtttttgattacgattctttcggccttaattgccacaccgtttgctatcgggacggcggtctttatgaccgaaatttcaccacgccggggggcgaagattctccggccagttacggaactattagttggtattccatccgtagtgtatggatttatcgggctacaagttgtcgtaccgtttgttcgtaatacgtttgggggtagtggctacgggattctttctgggacctttgtgctatttgtcatgatcttaccgaccgtgacgtcaatgacggcggatgcgctgaattcggtaccccgttattaccgagaagcctcgctagctctaggggcgacgcgctggcaaacaatttataaagtcgtcctgcgggcagccattcctggcatgctgactgccgtcgtatttgggatggcccgcgcctttggggaagctctggcggtccaaatggtgatcgggaacgcgacgttgttgccgcataacctagtttcaccagccgcaactttgacaagtatcttgacgatgggaatcgggaacactgtcatgggttcattacaaaataatgcattgtggtcattagccatgatcctgttattgatgtccttagtctttaacttagtcattcgctacattggtcgaaaggggaaattaaaccatgaacgctaaacgcatcgataaaattgccactggcgtgctatacggcgtcgcagcctttgtggtcatcatcttagttgccctattgggatacattctgatccaaggggtgcccaaaatttcgtggcattttttaacgtcgccggccctggcttttgaagcgggtggtgggattggcattcagttgtttaactccttctacttactatttttagcgttattgatttcattaccgatttcactgggtgcggggatctatctaaatgaatatgcgccgcaaaatacggtgactggcctgattcggacgaccattgaaattctgagttcattgccatccgtagtcgtggggctgttcggatacttgttctttgtagtgcagttcaagttaggcttctcgattctttccggggcgtttgcgctgaccgtgtttaacttaccgattttaacccggagtattgaggaagcactcgccaatatctcagataatcaacgggaggccggctacgcgttagggctatcacgttgggagacggtgacgaagatcgtggttcccgctgccttaccaagcattttaacgggggtcgtcttgagtgccgggcggatctttggtgaagccgcagctttaatctacactgcgggtcaaagtgcaccagccttggactttggtaactggaatccatttgatatcagtagtccactcagtccactacgtccagccgaaacgttggccgttcatatttggaagatcaactcagaaggaattatgccggacgcgaaagccgtttcggcgggggcttcagccgtattaattattgcggtattgctctttaacttcttagctcgttggcttggcaaacgcttgtacaaacacttaaccgctgaataaaggaggccgttttgatggcagataacacaatgacgacgacacaacgtaacatcatggcgtttgatcctaaagatcatgaaatcgcgctttcaactgaggatttacacgtcttttatggtaaatccgaggctatttcagagggcgatttacagtttgaacgttataagattagtgcgttgattggcccatccggttccggaaagtcaacctacttgcgttcgctaaaccgaatgaatgatcgtattgcaacggttaagggcaaaattatgtatcgcggcttagatattaacagtaatgatattgatgtctatgagatgcgccggcacattggcatggtgtttcaacggcctaatccgtttgccaaatcaatctatgagaatattgcttttgcactccgccagcgcggaatgaacaagaaacaagacttggatgaaattgttgaacggtctttacggcaagcggcgatgtgggaccaagttaaagatgacttaaataaaagtgcgttagctctgtctggcgggcagcaacaacgactctgtattgctcgggcaattgcaatcaagccagacattttactgctcgatgaaccagcgagtgctttggatccagtatcgacaagtcaaattgaagatactttgttagaactaaagcagaattataccattattattgtgacgcataatatgcaacaagcatcgcgaattagcgactataccgcgttctttaacctcggcaaagtcctagaatactcagagaccggtgagatttttaccaatcctcaggttgatctgacgaatgactatatttccggaaactttggataggaggaccgttcatgagtacaattttaacgaccgagaacttatcattattttatggtaaaaaagaggccctcaaaggaattaacattgattttgatgataaaggaatcacggctttgattgggccctctggctgtggtaaatccacctttttacgttgcttgaaccggatgaacgatctgatttctaatgtaacgatcacgggtgaggtgaacttcaatggtcacaatatttatgcgcccacgaccgatacggttcaattgcgtaaagagatcggcatggtgtttcaacagccgaatccctttccattctcaatttatgagaacgtcatttacgggttacggttggcaggagtccatgataaagaacgcttagacgcggcggtagaaaaaagtctgaagcaggctgcaatttgggatgaagttaaggaccggttgcatgccaatgcgctatcattgtctggtgggcaacaacaacgggtttgtatcgcacgcgtcctagccgtcgaacctgatattatccttttagacgaggccactagtgcacttgatccgatatcgagtcggatgattgaagaaaccctattgaatttgcgccaggattacactatcataactgttacgcataacatgcaacaggcgtcacgaatttctgaccgaacggcgtttttcctgaatggtgaattaattgaggtcaacgacacgaaacagattttcatgaatccagttaaacaggaaaccaatgactatatttcaggacgatttggttaggaggaaaaaaacatgcgacgactttttgatgatgaactaaacgatattgatgcaaacttcactgaaatgggaatgatggttagcgagacgattgaaaaggcagtcaaggcgtttatcgaccatgaccgcgacctcgcacaagaaatcattgataatgatgctaaaatcaaccaacgggaagttgaactagaacagaaatcatttgagatgattgcgttataccaacccgtcacttctgatttgcgagaaattgtcaccattttgaaagccgtctctgaattggaacggatggccgattatgcacgtaatattgctcacgctacgattcgggtcaaaggaaatgtgcgcgtccctgaaattgaggcagcgttatcagaaatggggaatcgcgtgcgaaagatggtcgaagagatgttggcagcttacgtcaaaagtgatgatcaggaagcacgccgggtcgcagctaaagacgcaaaagtcggggagatgtatgatcgtattaatgagaaggggatctccaagatggagcgccatcctgagacggtcatcggttccacggattacctgaatgttgcaacttacctaatgcgcatcggggcgttagtaactaatattggtgagtggatcgtgtatttgaatactggtgagattatcgaattgaatccagaaagttctaatttagtgtaactaatcataaataattgcttaaagccggtcgtctagtttgcaaccggcttttacaattagtaagatatggttagataaactgataaggagcgtctaacgatgaaatcaaatacaaaacaaaagttaactaaatctaataatcgcgttttcgccggcgtcctcgggggcattgctgaatatttgaactggaatgcaacgattctacgagtactctacgttattttaaccttggttacccatggctttggtgttttggtatacttagtattaatgacaattatcccaagtaaaccagacaatacgggtttcttcgaacagatgcggcaaagtaccggtactcaagctaaaccgcaagcgcatgggcgcaaagagattcataacgttcatgaagaggatgatccgcgtcactaagattaatggagtgattatacagtgggcttttggaaacgaattttaatcaatacaatcttatttattgcgattgctggcttttttcagagcagttttcacgttgcaagtgtgtggatggctttaattgccagttttgtgcttgcaattttaaacgccgctattaagccgtttttgctgttattatcgttaccgattacgttattgacactcgggctattcagtattgtcatcaatggttttatgcttcagatgacatcctacgttgtgggtaaggccaatttcggcttttcgagttttggcatggcgatggttgtttcgattctcatgtcaattgctaacgtgattgtttccaactttttcgcgaaagacggcgttgatggtgaataaagcgctttaaagtgctaagattagaagatagaaataatccgttttcagtcataaaagtgtggccgcttgaaagggtagcgtaatggcgcgactggacaacgcgggccacacttttttattagtggaacaattaggagggattcttttggcaggaagtgtaaccgttgccgatttggtgaaaaatacgcgcctggatgtgtatcatggcgctgacttattagaaaagaaagatattacaacgagcgacatttcacgtccggggctggcgttgaccggttacttcaactactatcctcgtgaacgggtgcaattgctaggtaaaactgaaaccgcttattcgaaaaatatgagtcatgatgaacgactgatgatttttcgtaagatgtgtcagttaaccacacccgcgttcgtcatttcaacggggttacccgttccagaagaactcgtgcaagccggtgaggaaaatggcgtgccgattttaggaacgaaaatgacatcatcacggattctaagtaatatgacgaattacttggaaggtaaattagctgaacgacaatctgtccacggggtattagttgacatctatggattaggtgtgctgattactggtgattccggtgttggaaagagtgaaacggccctggaattagtcaaacgggggcatcgtttgattgctgatgaccgggtcgatgtctatcaacaggatgaacaaacgcttgtcggtgaagcacccgcaatcttgaatcacttattggagattcgaggtatcggaattattgatgttatgaatctttttggcgctggggctgttcgtcaagatactgacattgatcttatcgtgcaccttgagaattggacgcctgataagcaatttgatagactaggaaatggaaaacagaaccggaaattctttgatgttgaagttcctgaaatctcgattccagttaagactggacgtaacctagcaatcattatcgaagcagcggccatgaactttcgggccgagagcatgggctacgatgcgaccaaggtctttgacgataacttgaacaagttgatcaaaacgaattccgtgcatgattctcacaagtaataaggagatggcagtagcgtgaataccgttttaggggcacttaacccaattgcactgcggttaggaccaattcaggtccattggtacggcgtcattattgctagtgccgtcgtcattgcggttgcactagcagtacgtgaaggtcagcgacggggtgttcggcccgatgacatttatgatatgattttatgggcacttccgtttactttaattgcggcgcggacttactatgtgattttccagtggtcatattatcgtcagaatcccggtgaaatcatccgtatctgggatggtggaattgccatctatggtggcttgattggcgccggaattgtggtcattttattctgtcggtcacgctttatcccaacttggctaatgcttgatattgccgcaccaacggtgatcatgggccaaggtattggtcgctggggtaactttatgaaccaggaggcttttggtcgagtgactagtctgagtttcttacaaggcttgcacttacctgattggctgattaatcagatgtatatccgtggcgcgtatcggcaaccaacattcttgtatgagtcggtatgggatctattaggatttgccttactgatgctcacgcgtcatcgcacacattggtataagcagggtgatgtcttcttgacttatgttgcttggtacgcctttggccgcttcttcacagaagggatgcggactgactcgctcatgctatttaacgttattcgggtctcacaagcgttgtcagtggtactgttctttggtagcattggcttaatgatctggcgccggcatcacaatccgaataatcgttggtatttagcgggttctggtcaaaaggttgtcgcagaaaataagtagattagagggttatttgaatgatgaaaaaaattgccgttttaggtgctggctcatggggtagcattttggcaaatctgttggatgaaaatggccactcagtgcggctctggtcgtactcaccggcccaagtcacagaattaaatgagcaacacacgaatgagcgatacgttcctgattttaaatattcagaaacgttgactgcttattctaatctaacacaggcgattgatggtgcggatgtaatcttgtttgtcgtaccaaccaaagcgattcgcgaagtggcccaacaagtgactgccgtgcttgccaagacccatcagcggccgattattgtgcatgctagcaagggactcgaacaagagacacacaagcggctgtcgcaagttttggcagaagaaattcccgccgaattacgacaagcgatcgttgtcttatcgggccctagtcatgctgaagaagtggcccgccacgatattacgttgattacggcggctagcgccgatgaatctgcagccgaattagtacagcaactcttcatgaatgactatttccgcatttacacgaataccgacgtggttggtgttgaactaggtgcggcgctcaaaaatatcattgccctgggtgctggtgcgctacacggcctgggctatggtgatgacgccaaggcagccttaatgactcgtggtttagctgaaatcagtcggctcggagtggcgttgggcgcagagccgttgacatttatcggtttatccggtgttggcgatttaattgttacggcaactagtgtccattcgcgtaactggcgcgctggtaatgagttaggtgctggtcaggacctcaagacggtgattgataccatgggcatggttattgaaggtatcccgtcaactaaagccgcttacgagcttgcacagcaacaaaatatcgaaatgcccatcactgaagcgatttatgatgtattatataagagtgccgacattaaggaagtcattccacaattgatgcggcgcgaggggaaacctgagattcagtaggaatttccaaactaatttcactatttttaggaggatttatcacatgtcaaaagttagaaaagccgttatcccagcggccggattaggaacacggtttttgcctgctactaaggcgatgcctaaagaaatgttaccaatcgttgataaaccaacgattcagttcattgttgacgaagctcgtaaatcggggatcgaagacattgttatcgtcacgggtaagagcaagcgtagtattgaagattactatgattctaacccagaattagaggataacttacgggctaagcacaaggaagaaatgctcaagctggttcaagaaaccacagacattaacttgtactttatccggcaatcacatccacgtggtttgggcgatgccgttttaacggctaaagctttcgttggtgacgaacctttcgtcgtcatgcttggtgatgatttaatggaagacaaagtaccgttaaccaaacagttaatgaatagctatgacaagacacatgcgtcaacgttagctgttatgaaggttcctcatgaggaagtttctaagtatggggtcatcaatcctgaaagtgaaaaggaaccgggcctatacaacgttaataactttgttgaaaagccatcacctgaagatgcgcctagtgatcttgctatcattggtcgttacttattaacaccagaaatttttgatgttcttgaaaaccaaaaacctggtaagggtgacgaaattcaattgacggatgccattgatacgttgaacaagactcagcgggtctttgcccatgaatttaaggggactcggcacgatgttggctacaagtttggctacttgaagacgacgatcgaatacgggttaactcatccggatgttaaggctgacttgcggacttacatcaaggatcttggtgctaagttatctaaagaagatagcgccgctcctaaaacaacgaagaaaccaactaaataatacttgattaatcaaaacaaccgtgaaatctattaagatttcacggttgtttttagttaactgctgaataattgcgattcactaattaagctggcacctagtggtcggcttttaatttgaataaatggggcttgccataataataaccttggcgtagtgaaatatttaagtcattcgccatttgatcttcggcatcgttttcaacaccttctagaatcaaccgaatatcgtgttgtaccgcaatgtcgcgccagaattttaattgaatgggaatctcgttttcacgatcttcggcccgaaagttttgcatggcgaatttgatttcttcggccgattcgagtagcggtttaatgtggtcgtaaacgttgattcccgtgccaacgtcatcaatgctaaattgtaggccgttagccttgtacttatcaatttgatgttgcatcgccgccagtgtaaacgtatcttcaccgggttcttctgtgacttcgacgataacatggaccgggaatagctttttctgagcatcaatgactgcggcagcaatatcatcatttagaaattgcttgcgattaaagttaattgatactgacccgatttttaatgcaagctcactagccgtagcctttagtaagctgacttgtacatcgatcggaatattatcgaagctttctggtaaggtccaccggtcctgatcagtctcacgatagcgaatcagcatctcgtagccaatcagtgaattattaaatttatctaactggggctgaataaaatagcggtacataagggaactccttagacttgaattaacacgatttgatgcttcctaatacatactataccaaaaaatgaataagtgaaactgtttgacaccatctttttttgcatggtatcgattatcaattgggctaatgatgattgtgctaaactgcttggtgaacaaggtaattttctgaaaatgagtaaaaagtcaattagtggttacctggcaaagctggtatggacgatattgtgagaataactgctttccagcgtatcgctgattggcttttaaaagtagttatgtttcatcataacctgtatttatattgaccagagttatgtatttgcgcagtaaagcggttataatatacctatggttaaataaataaaattataattgggagcaaaatgaaatgaagattgtaattgttggatgtacgcatgcggggaccgctgcggctgcacaaattctgaaggatcatccggaggctacggtcacgatttatgagcgtgatgacaatatttcattcttatcatgtgggatctacctttatctcgggggaaaggtcaatcacttggaggatatgttctattcgtcaccagaaacgttagccaagttgggggcaatggttagaaccaaacataacgtgttaaaaattgacgcccagtcgaagaccttacaagtggttgacatgactactggaaaagtgtttggcgatacttatgataaattgattatgacgactggttcaaatgttgcggtcccgccgatttttggaatcgatgagtctaaggtcctattatgcaagacctacagccaagcacagaaaatttaccaaacagcccaagacaatcagcggatcgcaatcattggggcgggttatattggaaccgaattatctgaaagttatgcgaatacacatcatgaagtaacgttattccaatcgcatgatcaaattttgaataattacattagtaaagaaatttcagaccaagcagttcagctattaaaagatcatggcgtgaacgtgctattgaatcaccaagtaactgcctttactggtaatgatgatggtgaacttgtcattgaaaccaatcaaggcgattttaatgctgatttagcaattgtcggaactgggtttgttcccaatacggaactgttacgcggtcaagttgagatggataagcacggtgccattatcatcaatgattacgttcagacctctgacccagatatttacgctgctggtgattcttgtgtcgttaacttcaatccaactgggcgttcggcttatacgccattagcaaccaatgcggttcggcagggtgcgttagcgggggccaatgtttttggtaaccagcaacgatatatggggactcaagcgacatcggctatgcaactcttcgatcacacgctggcaaccacggggttaacactggcaatggcgaaattgaatcatattccagctgaacgggtgacttatgagggcaactggcgaccagcttacatgccaagtacggcgaaactgacgattgaattaatttataatccggaaaatcgtaaaattctcggtgctcagttcttaagtgcgcatgaagtggcacagtctgctaatgcgttatcaatcgcgattcaaaatggaaacaccatcgatgatctagcatttgtggatatgttattctcacctaattttgatgaacccttcaattatctgaacctcgtcgcccaacaagcgattgaacaagaacgccaggcaggccgcaatcacccacgaattacggcctatggcgattgggccaagcaaaatgacaaggatttacaatagacgtccaggacgtctgcgttaccttgggtggctggtcgtgttagtgatgctgactgcagttgtcagtgggtgtcggaaacaaactacggttagtacaccacgacatgtgccaagtggatttgtaacgacgacggcctatgcgactaaggtgtcaaagcaacggcgggtaaaactagcggcatttattaaacgaggacttttgacgaagcaagggctttatacgaactatttagatacgcgtaaacggacgactgcaacggccactggtcatgaaatgttgagtgagtcatcggggatgtggctacagtacctggttacgactcgccaatgggaacattttcggcaattctatcgccagacgaaagcgacctttaatgaaaacgggttgttcagttatcgttatgatccacgtaccaagaagcggtatgcggtcaacgctacgttggacgatttacggataatccgtgcgctactggcttatgatcaagcacatcatactaatcattatcgccaggaagccacgcaacgttatcagaatctggtcaatacaacgatcaaggatggacacctggtcgattattacgatgttcaggcgcgtaaggaaactacgacgggcagtttagcttactttgatttacgaacacttaagtattttgaacaagatactaagaagggccggagtgcgtataagaagcaattgattgtccttaagggcggttatttaggtgatgtttttcccttgtatgcaaaaagttaccaatggactactagccaatatagtgatggtaacctgaatacatcagaggctttggaaaccttattgcatttagcagaagttggtcacctaaaagcgactagtcggcgatggctgattcaacgggtcacccaccgtgatttagcaaacggttatacgacaaggggcacggtgagtgttggtggtgaatcagcggccaactatgcgttagcggcgtcgatctttgcgacgctgggtgatgaaaagcattatcaagttgcgatgaataatgtttggcgattgcaggtacagcaagacagttcgccgattaacggtggtattggggatgccaaaactaagcaagtgtattcatatagtaatttgacggcgctaaacgcagcgtttaattagagattgaggtaatctttgtgactaagttaaaacaacaattttggcgcgcaacgcagctgtttcaacagctaatgccacccccactactcgcaactttactttgtgctggcttggctgcttatgtggcatttgtaccgcccattaacggactggctgataatggcgatttttatcgggcgatgtataccaatggtatttataagttgctgggaacgcactacaactattttgattttgtaacgcagaaatttggcttgatgaagtactacaacgactatcgatcggtgaacttttcatctcagcccttatttgtgaaagtggctatcggtctcaataaattattttatagtaagacggtatttgatatccggtttatgggcattgtgaatgtgattccttatctgggtggcatttatttattgacggatgctttgacgtatcctgccaagcgttttcgaaattatctgattgcgggattagtcgttctagtatttggtgattcttcatttacattgtatttaaattctttttttgctgagccccaaatgttaggactaactttaatctcattttcagccgtcttactgctagcgcgacaacgatatcggcggcggtggccactcgttgcattgtattttgtttgtacagttctattgataactaacaagtcacaaaacgccccgctagcattgagctttgtggtcgtgacgattgggttactatttttgccacactttaacgcaatgcgtgtgtacctgcttgcgggaatggtcatgatcttgatcacgggtggactgacctataaattgatcggtcaagactttgtggatatcaatacctatcagactttttcgcacggcatcttgacccaaaccgatgatcctagtaaggatcttgctcagaatgggattgatgagcagtatgccttaatgcagtcacaagactactacgctaaacagtttgcgacgattcaagcttctggttcttatgttaagaaaaacttggtttctaagctgggagttggttgggtattaaagtattatgcgactcatctgaagcagtttggcaaattgatggatcttgcagccgccgatgtcatgattactcaagttaaagcggttggggattacacccaagcgtcaggagcacccgcaggaaaacaactgacattctttacaacgtatagtcagattgccggggctttttttccacaaaagtttgcctttaattgtcttctagtagttgcgttagtgatggtttatctggttggtttttataatgatttgcgtcagcagcgaatcgaaggcgtcttgcggtttttcttagtattaggttttttgtcgatttttatttttgtgccaattatttcaatcattggtgatggtgatgcagatttagcaaaacatttatttatggttccggttagcattgatctaattgtcttgctgtttatttcggatatcttaaatcaccgtttgtggcatgcctatcgagaggaggaccaagatgcataagcggttatggcagttggtaatcatgggtgtcattatactttgtagctggttattgccgacagagatccacgctcaaacatcagcaacacacgttatgctggtttatgattcgcggaatgtggccaataatgatcaaaccaaaatcgcgatgattcaaagaatcctgaccggtctacacattagcatcaaaacggtggcggccgaagattatcatgctggcgaactacgacactatcaaggcgttattacgctaattaactggccgcagactaagctcaacaatgcagcgtttatcaaggatcgtaagcagttcagcggtacgaagctgcatattggcacaaatctgaccgctattgaggcccaacaattgaatgcccaaccggtcaaagtttaccaacagcagttctttcttcagagcaatgatcaacaagttcgccaattattaccatttatgagcagtatgacggcactcacaaagttacccgctaaggccaaaacaatcggctatttgagagcacaatcatcgctaaaacatgaatatccttatggaaccatcgttggtcgatacggttatctaccttatctttcaactggaggttatagtttagtgttagctactcagacaatggcaacattattcggtacccgtagtcattatcaaccattgttaacgattactaaggtaacgccgtattctaatcttaatttgttgaataaactcagtgcgaccttatatcaacaagggattccatttgcggttagcacaacaacggttggcactaatggcaaattcaaagcgtatcaacgctttgccaaagttttacggttaatcgaaaaccgtggtggggttattttcttaaaaacacctgtcgttggtggtgttacggcaagtagcggtcctggactgagcaagttgatggacagttacgtcattcagttagcacagaatcaggtttatccagttggaattagtgcttccgcttattggaaccaggacagggtctaccgccagaacgctttaactaaggcgaatcaggttctcttattacccgatcctaaggtgacgacttatgcccatcaagataatcaagcaacggtatttgatcaggccttttatggggttagtgctaaatcctttgaaacgctgaaatctggtgatcagctcagtaagttagcgctgaattttgccattcccaccgcacttacaatgactatgccagatagtgaaacgagtttacacaatttgactagacaattcagccgaatgaactatcagtggtttgaccctgcacaacaaatgacaacgacgatgctcaagagtggaacagcgacgatcagttatcggcgtggaacgtatttgttaaacggtgcgcccacacaagtgactgataatgcgccagcgacgacaaccttggctgcagtaaaaccagcagaaagctggatgaatcggttctttaaaactcaggggagtgtgttattgattttcttttcggtgacattgggaatttttgttttgtttattgtgattggttggcgggtttatttgaatatgtttaaacctaagtaggggacggcatcgttgctatcataacgggaggaattaatatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccatattagtattttagattattttctattcttggctgtattgtcgatttggggcattctagtcgtgaacgttgtcttaacgattgcgggctatgtgaattatttacaaaaggtgcgacgtcctgaacttcaattaccggtaaaggtaccctttgtctcaattatggtgcccgcgcataacgagggcattgtaatcgtcaaaacgttacagtcgttattgaattttgattatcccaaggatcgttatgaaattattattattaatgataattcggatgataattctgctgaattactggcggaagtgcagtcattgtatccacatcgaaacttgaaagtgatcaatacttataagactaatggtggtaagggaaagtcgaatgcgcttaatattggccttaaacaggcacgtggttcgttgatttcgatttatgatgcggataatacacctcaaagaacggcattacggtatttggtggctgagttaatgagtgatcaacggctagcggcagtgattggtaaatttcgtacgcggaacaagaatgcatcaatactgacgcgctttatcaatattgagacgctatcatttcagtggatggctcaggcgggccgggaaaagttgtttaaattatgcacgatcccggggaccaattatgttattcggcgagatattcttgagaaaattggtggttgggatgttaaagcactggcggaagatacggaaatcagttttcgcgtttatcgaatgggatatcggattcgctttcaacccctagccgttacctgggaacaagaaccccaaactttagatgtgtggtttcatcaacggacacggtgggtcaaaggcaatatttatgtcattttaaaaaacgcacggctacttttcactaaaacggggcggccaattcgatttgacttgttgtactttctatcgatttactttttattaatgacgtcgctgattttgtcagatagtatgttcgtcctttcagtagctggaatcgcacactccgacttggtagggttcagcaatatactatggctaatggccatcatcacatttgtaatcagtacgttcgtgacaattacaacggaaaaaggggaaatgacgattgccaatttaatgattattgtttttatgtacttagtctatagtcagatgtggctggcagtggctgcacatggaatggtggggtatgttcgtgaacaagtttttcatcaacaagcaaagtggtataaaaccaaacggtatcagtaagtggttcttctggttaataggcatgctcgctttattaattgggatgggtagtaatctaagctgtcctatcagtgggcaggcagcgaataatctacaaacttatacgcaaccttttcaaaactcaacaacgacactgtctggtgatgcagttgaggccaatatgtattttattaaaatggattattggcaagtcaaaaaagtgacgattaatctaaatttccaaatttcgcagttggccaatcgagagacatctgacattacgttgtcgttgaacggaacgaagttttactcattccggccccaaaaggagactggactccaaactagggctatcgaagtcccactgcggttaattcaaggtgaaaatcagttaaagatcagtgggcagatcctgaataaaaaaggccagcaaagttctcaattggtgcagacacctgccaactggttgacgatttacaatggggcgaatgctaactttgagtatcgcttgcaacccccaacaacggctattaaatctttttatgcgcatttttctgggactgataccatcgcgaatgctaattcagtcataacgctgccacatcaagcatcaaacgcagagttgtcagctggcatgtatgcgttaacgggtgaggcgcggaccattaccacggagaatacacagattccggtaacaacggcagataccgcggtggctaaacaggctgattatcagttggtcattgcgacttatcagcatttgcctaaagtgtttcagcagcaacttgatcgtcagcgactgcgagaacatgcagttatcaagacatatacgcatgatggtaaacattatttaattgtgagtgccttcaataccaaattattgcagaaggcaagccgatttattgctaatcaggaattaatgcaggaaacagtagcagatacgaaatacatcagtaacagcacacagacgtttacctctgagctacaatacggtggcaaaaagcaattgacgaccagcgatgattatttgactggcgctaaacatcagtcaagtacttattttgttagtctccctgttgatcggaccaatgctgatggttcgaaaatccggattcattttcgctatgctaagaacctggattttaaacgatcgcttgtaacggtttatgtaaatgattccgctttaggtagtaaaagactcacagcagcgcgtgccaataatgatgagttgaccgttagtctgccgaaaggaaaagcgctagggcatagtttcacgattcgtgtcgcctttgatcttgagatgagtggggcggctcaaagtgataatgcccaaacaccgtgggcgctgattaaggctgattctgaagcgacgattaagtcaaagccagtcgcagctttattatttacgaattatccatatttgtttttgaagaatgcgacctttaaccacattgcagttgttcgaccacgaacgctgactagtgacgattttcaaacgctaactaatatatttaatcttattggaacttatgcgcaaagtaatactggcaatattcagttttatacccatcagcctagtaaaacggtactcaaaaatagcaacgtaattgcgtttgggacgccagctcaaaacgcgtttattcggtctctgaattctaagctgtattttaaatataatcgacattttactgggttcctgtcaaatgagaaacttagtattgagaaaacgtatggtcaaaatattggcactacccagctgttacgctcaccgtataatcagcgagcgggattgctagttgtaaccgccgcgaagagtagtgatgtctaccgggcgtctactcaaatcaattttcaacggaacattgcccagtatcaaggtgatgcgattgtcgtcgatcacgataataatcattataattatcgttttaagaagcataagacagttaatgatggcgtgaacgccaaaacagttattcagaagaattctaagctagtgatttatttaggtattgcgttgctaatcgtggtgatcattttactggcaggattcctgattatgcgtaaaagtggtttgttagagcgaaaggggcagcaccatgaatgatgatcaacgaacatctatttttgctgacgtttatttgttattatttttagcgcttattagcacgatggccgtactgatggcgttaacctctaatatcacacttaatacgatctatttaggtgtaacgatcattatgattttgatgacttattttttcggtgtggtcactggtctaatggctaacttactattcatctttgctcaggcaatcgtcatgatttatattaattcaacgcatcacgccgtaattccaatgatgatgattttttggttgattatgccgttgcttttgtcagctactttttatggcatgacccggcaattaatacaattgcaagcggccaatgccaagctacgagcagatattatgaaacgaggggcctttgacgaacaaaccaatttgcgaacaactgtcgcatatattcaagatgcacaagtgtttatcgaaacgaatcgacggtttcaattaccggttaccacggttattattcgggtgcgatactataatgaaattcgacggatgatgagtgaacaacaataccgtgatttattgcggttggtctcggatacgattacatcggcaacgcgagataacgatattacctattcccttggtcagaataatccaacgtgggccatcttgttattttcagaccaaccaggcgcccaaattgcagcgaaccgcattaaatctaattttgaaaaaaatttacaacgctcaaccagcctaaattcattagaaatcttattggtggttggtatcgcgagttgggatgcggaaaagatgaagagcccgtatgattttatgaatactggcattaaagaaactgagtatgatgtggcgcgttgatttcggttgtgtacaaacaagatagtcgacaaatgtaaattttgggggtatattaagcgtcataggaatttaagtggaaggggtctttagaaatggcaaagagttacgacgtgattattattggtgcggggcctgccggcatgacagccgccctctatgcttcacgggccaatctatcagtactactattagatcgcggaatctatggtggacaaatgaataataccgccgcaattgaaaattatccgggcttcaaatctgttttggggccggatttggctaaagacatgtatgaatcagcgacccagtttggtgctgaatacgcgtatggtagcgtcgaatccgttgaagatcgtggcgatgttaaaattgtgacgacggatagcgatacgtttgagactaaggcccttgtcattgggactggttctgaatatcgtaagctgggtgttactggcgaggatacgtatggtggccgcggtgtctcatactgcgcagtttgtgatggggcgtttttccgtaacaagcatgtagttgtcgttggtggcggtgactcagcgattgaggaaggcacttacctgacacagcttgctgataaggtgacggttattcatcgtcgtgaccaattgcgggcacaacaaatcttacaagatcgggcttttgctaatccaaagatggaatttgtttggaatagcaacgtgacggaaatcatcggtgatgataagaaggtcacgggagttaaggttaataataataagactggtgaagacagtgagattgcggtcgatggtgtctttatctatgttggtattaacccaattacgaagccattcagtaatcttgggattactgacgaaaacggctggatcgaaactaatgaccacatggaaaccaaggtcccaggtatttttgcagtcggcgatgttcgtaagaaagatttacgccaagttgcgacggcggttggtgaaggcggaactgccggtcaaggcgtttacacttatatcactgctttaggcgacaaagttaacaattaaataaaattaaaaaatgcgtagctgatttaattgagatcagccacgcattttttattggtaaatatagcgttagtcattgtttgacgatgaccaaaggttcgcgaattagtgttgatagggaaatagaagcaattgcttgttagtatacgttgccaggtaaatatcactgacagtatagtgctgggcctgcaattgggtcagtaaccaggcttcatcatgattactagtttcaagcgcatcgaggttgacctgaccatcgacgattattggatacttgacggcgtcgtcgcccacttgggtaatcgtcagttggccgttttgttcaagtacggcccgtttgacgtagcgaatatccgtgataccttccgtacgcaagcgaaacatcagatcgttagcactcatcccatttttgagggccgtgctgacgagtaattgcccatttttaatcaatagctgtggctgtccatcaatcaaacgtttcacgtagcgattgtgatgtgttaggaatcgcaggaccagcactagcagtgtccagatgagaagcactaaaatgtattgtaaaacagtaacgctggtactataaatcatgcccccaacaattgcaccgagaacgtagttttgaacttggtcgagggcgctgattggcgcaaggttacttttaccagatagattgatttgtagaatgatggtcaatagcccgagggccagtttgatcgtcacatcccagtatgaaaacatttattgcccctccttaacataattgattgttgattgaatcggtgtggctttagtcagggtataactgtttccatccgtattgatcgtcacgttatagatatggtcatggactttaatgagcatcccactgctgacagaactcgtattagaccagaccgcggttttacgaaccccattttctttggcgacacgctgcataatttgtgtcacttgtgatttttggttaaaactatttttgattgtctgccattcattaaattgaatgccgacgagcagcaataataataaaaccatgataatgaacaagtcgcggtattttaggtctgttttatggcggtaccataaccagctgagtatggcgattattaatataatgatgccgatggctgcgagttggacaagagtatgattgttattttgatggactaagtaattgtatgaataaaaagtcatgatggcctccttataagatttattatagcaagttttgatagtgactgaactaactagcacttcagaatttatgggtattcgcactgatgcgggcccactacgcatttaaaatgcgttaattaatggattttcttagtaaattttactttgtaaagtgtgtcaatgttgtatactgtttttgtaagcactaacaaatatcggaattggagatggtttttgtgagttggcaggatacttataatacctggaaaaaccaagcgacacttgaaactagtttaaaacaagaattggcaggcatggctggcgatgacgccgccttagaagacgccttttatgaaccaatggaattcggaaccgcggggatgcggggggtactcggacctggtatcaaccggatgaatatttatacggttcgtcaagcaacggaagggttagcacgcttcatggataccttgcctgctgaggttaaggaacgcggggtagcaatcagttttgattcccgccatcattcagaagattttgcgcacgaatctgcgcgagtattgggccaacatggtatcaagtcatacgtttttgaaagcttgcggccaaccccagaactttcatttaccgttcggcatctgcatacttacgcagggatcatgattacggcgagccataatccgaagcaatataatggctacaagatttatggcgaagatggtggtcaaatgccacctaaggaatctgatcttatcacatcatatattcgtaaagttgaagatgtctttgcgattgccgtcgctgatgaacaacaattattagctgataagacggaaaccattattggggatgatgtcgatcaggactacttagctaaagtcaaagaagtgacgatcaatcaaaaactagtggatgaagtcggtaaggacatgaagttagtcttcacaccattacatgggactggccggatgcttggcgaaaaggctttgaagaatgccgggtttaaaaacttcagtgttgttaaggaacaagctgtggctgaccctgaattctcgacggttaaattccctaatcctgaatttcctgaagcctttaagatggccattgatttgggtaaaaaagaaggtgcggatgtcttgattgcggttgatcctgatgctgaccggttagggacagctgttcgtcaacctaatggtgagtatgttctgttgacgggtaatcaaattgccgctgtcttgttacactacatcttgcaagcaaacaaggatgccgggacgttaccgaccaatgcggccgcagttaagtcaattgtttcaagtgaatttgctactaaagtagcggcttcatatggtgtcacgatgatcaatgtcttgaccggtttcaagtatattgctgaacaaatcgaacattttgaagccactggcgaacatacctatatgtttggttttgaagaaagttacggttacttaatcaaaccatttgttcatgacaaggatgcgattcaaaccacagtgcttttagccgaagtagcggcttattataagcaacaaggtaagaacctttatgatggattacaagacttgtttaaggaatacggttacttccgcgaacaaaccacgtccgaagaatttgatggcgttggcggcagcgataagattgcggctctgatgactaagttccgaagcgaagcaccaactgcctttgccggctacgatgtcactgggactgaagacttccagagtcaaacggaaagctttgctgatggccacacggcaccaattgctttgccaaaggcgaatgtcttgaagtatcatttaaatgatggcacttggatcgccattcggccatctggtacggaaccaaagatcaagttctacattggaacgctaggtagtacgttagaagaagctaatgataagttagcgaaatttgaagatgccattcaagcatttattaaagaataaattggttattaagtcagaagttgtacggcccagctgactagccatgctaagtgataaataacgccttacgaaatttcaagttaatttcgtaaggcgttatttagttgttgttcatattagaaattaattcattgtcggatattcaaagttgacggggtcacctggtaggcgtaataattgcggtttgccatagtaatagccttgtcgaagattaatatcgaagtgactactcaagcgatcatcttcggcgtcttcaatcccctctaagattaaacgcaatccgtattcactactgatggcccgccaaaaatggagcttttgctgaatcttaggatctttgatatcactgcggaagttttgcaacgcaaattttaattcagaagctaatggcaaaatttcttggatactcttgaaatcgttaattccagtaccaacatcatcaagtgaaatttgcataccatgttcgatgaacccccgtaagtgtgggattaacatggtatctggataatccttaggactgcgttcctcagttagctcaacgactaatttagcaggatagagctgaacctgactttgaataatggccttcgcaaccgttgtatccatcaattgttcgcgactgatattgactgcacaataacgaacttttagtccaagaattttagtcgttgcaatgagcagatcagaggtaacttgtgaactaattgcggcaaaggattcaggcagacgccagccgtctggggttagttgtttgattagtagttcgtatccgtaaactgtattgttgagtaagttaagttgaggttgtacaaaatagcggtaaattggttccataagtaccatcgccttttataataagtttaaaatcattgaatcgttttaatatcaaccgaatcgctgtatactctaagtatacgtcaacttaaataaatgtttaacttaatccaagttaaattttaacttttaatgaaagctgtggtcgaaacaatgaaagttgccattattggctgtacacatgcggggattgccgccatgaaacaaatcttgaaatattatccgggcactgaaattaccgtctatgaacggcacgcggatatttcatatatgtcttgtgggacttatctacacttagggggtaccatccataatttggatcaagcgttgtacgctaatcctagtgaatttagtgaacaaggtgtgcagatgcggatgcagtatgatgtgatcaatgtgaatgctgataagcatacaattttggctcaaaatttacagacaaaagaattacaaacggatcactatgataagttagtcatggcgacgggttcaatcactgcaatcccggctattccgggcgtagagaatcctaaggtcatgctttgcaaaacatgcgaacaggcccagcaactctacgaagcagctaaacatgcacaccatattgcaatcgttggtggtggctattcgggggtggaacttgctgaggggtacgtgaagtccggacacactgtgacgttgtttcaacggggcccccacttaattaatgagtatcttgatccacaaatttctgagaagatcgaagacttgttaacgacgaagggcatccaagttagaaccaatgcacaagtgacggcttttagtgatacggctgataatcgactacgagttgccaccgctgatagtgaagaaatatttgatatggctgttatttgtccgggtgtgattccacaatcagagttattggcgggacaggtcaaccgaactaagcagggggccattgtaacggaccgttatatgggaacctccaacccggatatatttgcggctggcgatgtgacggaaattaactttaatcctacgaaggaacacgcctatatgccattagtctcacatgcaattcggcaaggtgcactggcaggaattaatatctttgataaacgcttaggtgcaattggtacgcaagcgacgactgggatgttgatttttgatcagaccgtggcttgtgcaggtctgaccttaacggcggccaaagcagctaacttcgatgcccaagcagctttttataaaggcaattatcggccggactttatgcctaccacggcgaaagtcatgattgagttggtttatgatcaacaaacgcggaaggttttgggtggtcaactaatgagtgctcatgaagtttcacaatcagcaaatacgttgtccgtagtgattcataatggtaatacgattgatgaattagccttcatggatatgctattctcacccaactttgatgaaccgtttaattacttgaatttagtggcgcaggctgcagtagatcaggaacatggctatcgtcggaataattaagtttttgcactaattatggtcagaaggtgctggttgttaaaatcaagaacagccagcttagacccgctggaataagttcagattagcgtaaacttgtttggtgagtgcgtccgataccgttctccaggtattgctgccaattgctgggatggtattcaaaacgaatgtgctacgttaacgtttgttccaagtctaacggagtagatggttcagcgacagattagcttgggttaagcggccgttcatctgccactcgagtggtttcctggaagtcagacgaggacgcgcatatgctgacgggcaacaatccaactaactagcatgttttaataataagtgctggtgaatccataaaaataatgagccaaataaggtgactgccaaacagtgggtttcataacctgactgtttggcagtcacctttatattatttgaaagtgattggtcaagcatagtcgttgggatcagcggctaggggttggtaagcgtccatttcggtgtcgcggtagtcccaccattcgttaacgtagccgacaaagcccgcggcggtcatggcggtgtccagcagctgataatttttttcttgaagtgcggttcgaggagcgtcacggtgagcagctgccgtgaagtcatcgaaggcagttggcattgttaactcactaccatcaggatgggccagggtcaaatctaaggtgacgcctttttggtggctgaaattaggattaggctgggcaacaaattctggatcaggatacacttcaaataaacggcgctgggcgctgacgggccgataagcatcccagactttgagtcgataaccttgttgtttaaccagggcgcttgccttggcgagtttgtgggccgtgccagtgcgaacaatggccgtggtaaagtcgtaaatcacttgatgagtaaagttattagtggtggcataacgcaggtcaacgatgatttcggagtctaagtgttgaatattggtgaaaccagttaaagcttgatccatagtaggtcctccttagaatttagttatgcttattgtatctgattggccgatattttaccgactaaaagggttgcaaatggtgtcaaactttctgctagctttcaatccgggtccctgatatgatggaaagcggtgtaaatttaacaattgattgaagaggtgaggtcgcatggatcgacaaacacgacgcgcaattttaattttagtttttagtgagtttttagtttgtttagggattagtttagttattccggtcatgccgtttattaaaaatgaactgcatttaacggctaccgatatgggaataatgaatgcgctattcgcattggcacaatttgtggcctcacccattattggccgggtttcagacaaagttggtcgcaagcccgtattaacggtagggctagtcttatatatggtctcggaagtactatttgcgctaaccaaccagctgtgggtctttaatatttcccggattgttggtggcttatcagcagcgatggtcgttccgacggcgatggcgttagcatccgatattacgaccaaacgacagcgagctaaagtaattggctggttatcggcggcctttagtggtggcttgattttaggacccggtatcggtggggtattggctggcattagttataagacgccgttctgggttgctggtgcattgggattactcagtgccattgtgctcgtcattatgttgcctgcggatcgtcagattgatcctgatcgcgaagcaattacgaccacgacaacgacgaccaatcatccgatgacgcgggcattttggaccgtcccgattattatattatttacgatgattttagtgtcttcctttggcttacaggggtttgagagcatttatagtatttacgtgaatgaagtctttcactttagtctgagcaacattgcgttggtcttgactttaaatggtttgatttcgctcttcctacaggtggcactatttgatacctttgtccagcgttggggcgaacggcgggtcattcgggtgtgctttgcagctgcggcgctatgcactatctggattacgcaggctcattcgaaagttgctgtcatgtttgcaacgctcgttattttttcggcattcgatcttttgcggcctgctattacgaccctattaacgaaagcaagtgaggccaaccaggggctaatcaatgggcttaacatgtccttaacgagtgttggcaatatcgttggcccaatcatgtcagggatgttactagatatgaattatcactatccatatctggtggtggccggattcttgattgtttcttatttaatggcgtttatgttacgattactgaaccaggttcattcacatcagcaagtttaacattgcataacagttaagctaatcagcgacagcgctccgggtttgcgtccccggggcgcttttgttacacttaggccaaattagattgaaggatggtgggctgcaatgggaatgcatcaatattttcagagcttaagtaatttagaaacgattcaacgggccccgggttttttcaagtatcagaatcattcagttgcggcgcattcattcaaagttgccgaagttgcccaatttttaggtgatgtggaagaaaatgccggacaaattgttgattggcgagccctctatgagaaggcgctgaatcacgactataatgagcggtttatcggggatattaagacgcctgtcaagtacgcaacgccgacgctacggacgatgctggcggatgttgagcataaattatcacaaaattttgtgcaaaatgagattccagctgagtttcaggcagcttattcacggcgtctatcagaaggtaaggatgaaacgctagaaggccagatattgtcggtagccgataaaattgacctattgtatgagttatttggtgaaattcaaaagggtaatccggaaccagtttttagggatatttatcaagaaagtttaaaaacaattgtcgcgtttaaaaagatgactagtgttcaatatttcttaaaagcagtgctaccagagatgttagcggaaccgttcacgcatcaggatcaattacaggcgctgacaacccagattttaacggccgggccgcaatccgattaatggcgaaagtatgttcgatgtgctaaaatcaaatgcgatttgaatgtgatagggaagcgcgggcttgcctattttttatggtgcgacagtaagatttagttatcaatagatgatatgaacgggtgaccgtttaaaaggaggactacgtttgattgatcgggtagataataatcattttgacttagtttcagattaccaaccaacgggcgatcaaccccaagcgatccagcaattaactgctggcattgaatcgggagaaaaagagcagatcttgttgggggcgaccgggaccgggaagacctttacaatttcgaacgtgattgcaaaggtgaataagccaacgttaatcttgtcacataacaagacgttagcgggtcaattatacggggagtttaagaagtttttcccgaacaatgccgttgaatattttgtgagttattacgattattatcagccggaagcgtacgtgccttcgagtgatacctatatcgaaaaggactcggcaatcaacgatgaaatcgataagttacggcactctgcgaccagctcattattggaacgcaacgatgtgatcgtcgtggcatcggtctccagtattttcggtttaggggatcctcacgagtaccaagatcacgtagtctcactgcgagtcggcatggagatcgaccgcaatgatctgttgcgtaaacttgttgatattcaatttgatcgtaacgatattgatttccagcgggggcgttttcgggtccatggtgatgtcgtagaaatctttccggcttcacgggatgaccacgcattgcgcgttgaattctttggcgatgagattgatcgaatccgtgagattgacgccttaaccggtgaaattgtagctgatcgtgaacatgttgcgatcttcccagcgacccactttatgacgaatgatgcgattatggaacatgccatcaagggcattgaagatgagttggatggccgcctgaaagaattgacggccgatggcaaattgttagaggcgcaacgactcaagcagcggacgacctatgatgtcgaaatgctcaaagaaatgggctacactagtggtatcgagaactattcacgttttatggatggccgtaaacctggcgaaccaccgtatacgttactggacttcttcccgaaggactttttgctcgtggtcgatgagtcacacgtgacgatgcctcaagttcggggaatgtataatggggaccgagcacgtaaacaaatgctagtcgattatggcttccgtttgccaagtgcgttggacaaccggccattgaaacttgaagaagttgaacagcatattaatcaagtggtttatatgtccgcaacgccgggcccttacgaaatggatcggaccaagcacgtcgtccagcaaattattcgaccaactggtttattggatcctacgattgaggttcgaccgattatgggtcagatcgatgacttagtgggtgaaatcaataagcgcattgaagtcaacgaacgggtctttatcaccacgttaactaagaagatggcggaagatttgaccgactactttaaggatttaggcatcaaggtacggtatttgcacagtgatattaagacgttggaacgaacgcagatcattcgcgacctgcgtctgggcaagttcgatgtgttggtcggaatcaacttgttgcgggaaggaattgacgttcccgaagtttcactagttgcgattttggatgcggataaagaaggtttccttcgtaacgagcgttcattgatccaaacaattggtcgggcggctcgtaatgagcacggttcagtgattatgtatgctgacaccacgactgattcgatgcaggccgcgatggatgagactgcacgtcgtcgtgccgtacagatgaagtacaatgaagatcatcacatcacgccacatacgattaagaaggccattccagagctaattgcttcgacgaagaccactgaagacgcgggcaagaaggatgacttcttagaaaccgactttgatgatatgacccgtgaacaacaattagatatgattagtaagttggaagaacagatgaagaccgccgctaagaagctcgactttgaacaagccgcaacgctgcgtgatacggtcatggaattgaaagcacaaattagctagcaggttgctggcttgagattgaggaggcctttttttggcaaatgataagattgtcattcacggtgcgcgagcccataatttaaaagatatcgacgttaccatcccgcgcgacaaattagtcgtgattacggggctgtctggctcaggtaagagttcgttagcgttcgataccttgtacgcggaaggacaacgtcgctacgtggaaagtttgtcagcgtacgcgcgtcaattcttaggacagatgcaaaaaccagacgttgattcaattgatgggcttagtccggctatttcgatcgatcagaaaacaacatccaaaaacccgcgctcaacggtcggaaccgttacagaaatcaatgattatttacggttactgtgggcccgagtcggtgaaccgatttgcccgaacgatgggacaccgattgcgagtcaaactgttgaacagatggttgatcggattcagaaattaccggaacgaacgaagttgcagattttatcaccaattgtccgccagaaaaagggcgagcacaaaaagatctttgaaaagatcaagcgtgaaggtttcgtgcgggtccgtgttgatggtgatattcatgatatcagtgaaacttttgaactgaacaagaatcaacaacacacgattgaaatcgtcattgatcggatcgttgtgaagtcaggtgaccgttctcggttatttgattcttttgaagcggcgttgcgattaagtgggggctatgcgattgcggatgtgatcggtggcgaacccattatgttctcagaacattatgcttgtcctatctgtgggtttactgtgggagaacttgaaccacgattattctcgtttaacgcgcctcagggagcttgtccagactgtgaaggtctcggaatcaagctagaagtcgatgaggaccttgtcgtacctgataagtcgctgacattggctgaaggtgcgttagcgccttggaatccaatcagttcacagtattatcctgaaatgttgaagcaagcttgtgaacagttagaaattccgatggatgtgccgtatgaagacttatcaaaagctgatcaacaaacggttttgtatgggtctaacggaaagacgttccatttccactaccagaacgactttggtggtgttcgcgatgttgacgctgtgtttgagggcgttatcaacaatgttgaccgccgctaccacgaaacgaatagtgatttcacccgcgatgtgatgcgaaagtatatgacggaactcacttgtcagacttgtcatgggttccgcttaaatcgcaaggccctgtctgtcaaagttggtggcgaacatatcgggatggtctctgacttagccattggtaaggaactcgatttctttaacgagttgagcttatcagaacaaagtctcgtgattgctaaaccaatcttgaaggaaatccgcgaccggttatcattcttgcaaaatgtgggactggcgtacttaacgctcagccgttctgcacggacgctgtctggtggggaagcccagcgaatccggttagcaacacagatcggatcgaacttgtccggcgtgctctatatcttggatgaaccatcaattggattgcatcagcgggataacgaccgcttgattggttcacttaagaagatgcgcgatctggggaatacgttgatcgtggttgaacatgatgaagacacgatgcgggccgctgactatatcgtggatatcggcccgggtgccggtgaaaacggtggtgaggtcatggcggccggaacgcccaagcaagtggctcgctcgcggaagtcactgaccggccaatatctatcgggcaaacggtttatcccactacctgaaactcggcgtccgggtaatggtaagaagattcgtatcactggtgcggccgaaaacaacctcaagcaaattgacgttgattttccactaggcgaatttgtcgtggtaacgggggtttccggttctggtaagtcgaccttggttaacgatgttttgaaacgcgtattggcacagaagttgaatcgtaattctgaaaagcctggtaagtataagagtgtcagtggtattaagaatattgaacggttagttaatattgaccaaagtccaatcggccgaacaccacgcagtaatccggccacatatactggtgtctttgacaatattcgtgatttatttgcacaaacgaatgaagctaaattacgtggttacaagaagggccgctttagttttaatactaagggtggtcgttgtgaggcttgtcacggtgacgggattctaaaaattgaaatgaatttcttgcccgatgtctttgtaccttgtgaagtgtgtcatggtaagcaatacaattctgaaacgttggaagttgaatacaaaggcaaaaatattgccgatgttcttcaaatgaccgcttcagaagctgttaagttctttgaaccaattccaaagattcgacggaaactacagaccttggtcgacgttggtttgggctatgttaagttaggccaacccgccacgactttatcaggtggagaagcccaacggatgaagttagcttccgaattgcacaaacaacagtcggggaagaatttctacatcttggacgaaccaacgactgggttgcacagtgaagatattcggcgcttgattggtgtcttggatcggttggtggatgcgggtaataccgtgttaatcatcgagcataatttggatgttgtgaagtcggcggattatttgattgacttgggcccagaaggcggtgacggcggcggaacaatcgttgctactgggacaccagaacaggtcgctgaagtggctgaaagttatactggccaatacttgaagcccgttctagaacgggatcgagcacgtgaagcaactgcacctgctaaataacgggcaatgtgctacacttgagtttgtaatgtaattttaatttagaggagttgtttgtacatggctaaagtagaaagttttacattagatcataccaaggttttagcaccttacgttcgtaaaattacggtggaaaatgggcctaagggtgatgccatcactaattttgatttgcggttagttcaacctaacaagaccgctattgatacggcgggcttacacacgattgaacatatgttggctgggttattacgtgatcggatggatggcgtgattgactgctcaccatttggttgtcggactggttttcatttgattacttggggtgaacatgacaccgttgaagttgctaaggcattgaagtcctcattagaattcattgctggcccagctaagtgggaagacgtacaagggacgaccatcgatagctgtgggaattacaaggatcattctttattctcagctaaggaatgggccaagttgattttatcgcaaggaatttcatcggatccatttgtacgcaaagtcgttgaatagaccaaaatataaaaagtaatggtggtgccggccaccaattaaaaagagcctagcttttcataacgaaaagctaggctctttttgctgtttactgacattgtgcgagcttagcggtcctgaatcgtgggaaaacaatctaagattagattaaggtagtgtttcaaaaataacaaaaaatatactgatgttggtgaatatttgaataaaaattctgtatttcagttaatattgcgcaaataatgaatatatttaaaatattattgaataaagttaaattgggtggtacgatactgtcattgataaaagcaaagataaaaatttcggaggtacaaatcaatggtcaaacaaaatgataaaattattctcgcttattctggtggtttagatacgtcagtcgcaattagttggttgaaggataagggctacgatgttgtggcctgcggaatcgatgttggtgaaggcaaggacatggatgcaatcaaagaaaaggccctgaaattaggtgccgtttcatcatacatgattgacgctaagcaggaattcgctgaagaatacgcgttaattgcgttacaaggtcatactttgtatgaaggtgaatacccgttagtttcagcactttcacgtcctttaattgcgaagaagttagtcaccttagccaagcaagagcacgccgtagccattgcccatggttgtactgggaagggtaatgatcaggttcggtttgaggttgctatccatgctcttgcaccggatatcaagatcgaagcgcctgtacgtgattggcactggtcacgggaagaagaaatcgattacgctaagaaacacaatattcccgtaccaatcaatttggacagtccttactcgattgacgaaaacttatggggccgggccaatgaatgtggcattctagaagatccatggcagggcgcgcctgccgatgcgtttgaccgcacgaaggccttagctgatacgccggatacgccaacgactttggaaatcacttttgaagctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagttcgggtacaactcttcaagggtaacgttattactgaggggcggaagtcacccaactcactatatgatacgaacttggcaacctatacatcagcggattcatttgaccaacaagcggcagttggtttcattaagctatggggcctaccaacgcaagttaatgcccaagtccaagcgaaggctcaggccgaagctaagactgataaggcacacgcctaatgagtacccagaagctatggggtggccggtttaccgaaacgggtgctaagtatgttgatgactttggggcatcaattagctttgaccagttgcttgccgcagaagatattgctggttcactggcacacgttaaaatgttgaagaaaactggtattttgcccgccgctgatgttgatcaaattgttgctggattggaaaccttggctgagcgtcaaaaacaaggtaagttggaattttcaacggtcaacgaagacattcatatgaatattgagtcattattgaccgaagagattgggccggtcgctgggaagttgcacacggcccggtcgcggaatgaccaagttgccacggatttccacttgtacttgaagcatcaattaccactaatattggaccggctacatgaactggaaacagtattggtcgataaagcgagtgagaacgtggagacggtcatgccggggtacacgcatttgcaacacgcccaacccatctcgtacgcgcactacctgttagcttattaccaaatgttcaagcgggacatggaacgcttcgagtttaacctgaagcataccgatatttcgccattgggagccgctgcacttgctggaacgacttttccaatcgaccgggaatatagtgcgaaactattaggattcagtgaagtctatcataatagtttggatgccgtttctgaccgggacttcgtgcttgagtttctcagcaatgcttcgatcctgatgatgcatctctcacggttttgtgaagaaattgtcagctggagcagttatgaattcaagtacatcagtttgagcgatcagttttcaacgggtagttcgattatgccgcaaaagaagaaccctgacatggccgaattaattcggggcaagtccggccgggtttacggcaacttgatgggattgctaactgtcatgaaagggattccgctcgcttacaataaggatctgcaagaagacaaagaaggggcgtttgatacggtcacgaccgtgttaacgagtctccacgtcttcaccggcatgttggcaacgctgaccgttaatgaagatcggatggctgatgccacgactaacgatttctcaaatgcgaccgaactagccgattaccttgcaaacaaaggaatcccatttcgggaggcccatgccattgtggggaagctcgtcttggatggcttgaaaaaacagcggccgttgcaggatattccactcaaagaatatcagtcaatctcaccgctgatccaagaagatgtctaccatgatttgaacgcaaaagttgcggtggaacggcggcattcgctaggtggtactggttttgatcagattagacaagaattgcaacgggcacaaacgcaattgtcagcctatcaatctgaaaccactgattaattaatgcttatcaatttgaccattgatattatttttaaagatgacctctaagtggcggagcctcggcatttagaggccatttttaatgctattgacattttgaaaaagcattaagctaacataaagtctatcagaaaaattggaaactcttacattaactggtaagatggaattaatatcggatatgggagatgttgatgtatgtttaatgatcatcgctgggggtttgattggactgaattcatgacggggatcgttttcttgatcgccgcttactttgtcatcaagcaaccacaagtagcacttttaagtttagtctttttatttgccatcgccgcaattattagcggggtcaccacaatcggtgggtacacaaaactacgccgtgaaacagggttgcgggcaaactttgcccttgtgtttgcgattattgatattttagtggggttattatttttattccacgcaccgactggggtactggtactcggttacgtctttgccttttggttcttgatcgattcgattgaacggctgaccgtagtctcacatctacgcgtctttggaaccgggtattttgttctatctttaatcttggatattattagtttggcattgggaatcttattagtaatcaatccaatgattgctgtgattagtttcaacgtactggttagtttctactttgcagtttttggcatcaacgcaatcttgattgcttttgctcggcgtaactagcttggcagtattgactcgttagcgatacttggcgctcactattggtggtgtcagggtgttgttaaggggtctttttttgcgcgttaatgtaatactgtttggaatcaaatggcgggtcgaagtggcacgtcagtagaaatgacacacccggtgtgttatactaccaacaatatggactagagggggccaatacagcatggcagaatcattacaactagtaattatttctgggatgagcggtgccggtaagacggttgcggttcaaagctttgaagacctgggctatttttgcattgacaatatgccaccagcgttattaccgaagttctcagaattagttgaggagtcgggtaaaataaagaaagtagcgttagtgattgatttacgctcgcgggctttttacgacgaaattatggatatgttggctaacttagacaacacggactttgtgtcgacccggattctgtttttagatgcttccaacgaagaattagtgtcacgttataaagagacgcggcgttcccatccattagccatggaaggtcgcgtcatggatggcgtgcgcaaagaacgagaattattggcgccattgaaagatcgggcttcatacgtcattgatacgtcgacgttgacaccacgtgaattacgcgaatcgatttttgataaattcgaaacggatcaggatgagacttttcatattgaaatgctatcattcggttttaaatacggactcccgattgatgcagatatcgttatggatgtgcgcttcttgcctaatccatactacattcctgaattaaagaagctgacgggactagataaacctgtggcggattacgttatgcagcaaccagctacggaagctttctaccagcagttcttgagtatgctggaaagcattatgcccggctatgaagccgagggcaagagtagtttgacgattgcgattggctgtacgggcggtcaacaccggtccgttgccttgacgcaacgtatcggtgaagcgctggctaagcactacaaggtgcacatcagtcatcgtgatattgagaaacgaaaggaaactgttaatcgctcatgagaaaatacacatttaagacccagcggcctaaaattgtggtgattggtggaggaaccggtttgccggttgttctgaacggcttgcgtaagcaggcagtcgatattaccgcagtggtgacggtggctgatgatggtgggtcatccggcattattcgcaattacgttaacgtggttccacctggtgatattcgtaatgtaatggtggcgttgtcgagttggccggatttgtataaagatatttttcagtatcgtttccagggtgatgatcaattttttgcaggtcatgcgattggtaatttaattattgcggcactaacggaaatgaaatccggggtgtttgacgcggtgcaggaattatcaaatatgatgcaagtagatggtcatgtttacccggcagccaacgaggcactcacgctacatggtaagtttagtgacggtaccgagttagtaggtgaagccgaaattaccgctgcccataagtcattggaacgtgtttgggtcactgacaagaatggtaaggaaccacaagcagttcaaccagttattgatgcgattatggcggcagatcagattgttttggggcccggtagtttgtttaccagtattctaccgaacctaacgattggaaatattggtcgggccgtctgtgagtctgatgcagaagtggtttatatttgtaatattatgactcaaaaaggtgaaacggataatttctccgatgctgatcatgtgcgggtcttaaaccgtcatttggggcaaaactttattaatacggtgttagttaacaccgaaaaagtgccagaagattacatggattttcataagtttaacgaagtttcaaagcaagtgagtcatgacttccgggggttacgtgaacaaaactgtcgcgtaatctcatcgaacttcttgaaactccgtgataatggggcctttcatgatggcgaccaagttgtcgctgaattaatgaatctagtcggtcattccgacgttttcagataagggggtcgtggcatgtcatacgccagtgacgttaagaaagaattgactaacctcgctgtccatcgcgagaatgctaaggctgaattaatggctttgattcgaatgaatggggcgatcagcattgctaatcatcacttcattttgaatattcagacggaaaatccggccatcgcgcggcgtatttaccggctactcaaacaattttatgacgtcgatagtgaattgattgttcggcgcaaaatgaaattaaataagaataatttgtacatcgtacgattgaagaccggtacggacatggtactcgctgatttgggtattttaaaggattatcaaatcgttgaagtggcaccaactgaagttttaacggatgatgctgcggtgcgttcttatttgcgtggcgcctttttagcgggcggttcggttaataatcctgaaacttcccggtatcatttggaaatttactcactgtatgaggaacataatcatatgatctccgagatgatgaatcagtatggcttgaattcacgaacgactgatcggcgtggtggtttcattacgtacatcaaggaagcggaaaaaattgccgacttcttgtcgttggttggtgcgaccaatgccatgcttaagtttgaagatattcgaatcatgcgggacatgcgtaactcggtcaatcggttagttaactgtgagaatgccaacatggataaggttgccaatgcctctagcaaacagattgaaaatattttattgatcgatgccacggtgggattacaacagttaccaccaaaattacaagaagtcgctgttgcccggttggaacatcgtgaagttagcctcaaggaactaggaacccttgttccgggcgggccgatttctaagtctggaatcaatcatcggctgcgtaaaatcaatcaatttgcggaacaattacaaaaagatgcttagttgtcgataaggatggcttaagcatgagttttgttgaaaagcttgctaaccattttagatggtgttagcggctttttttggttgaaatggattgattgtcgttcgccatactcgaaaagcacttgacaaaagtaagtgcaactatttatactgaacacatcttattgaaatcggagagacgtaattatgcaaaaatcaacaatgcaaatgatgatgtgctgcccatgttgtgaatcaaacaacatggctatttgcgttgaattacaagcgtctctgcatcaaaaataacgggattgagctcaaatcgttaattttgaaacgcctgcttggaatctgacgagattctgaacaggcgttttttgttacaaccgatgggaataagtagatcaacacatcaaaatgggaatgtaaaggggcgagaagtttgaagaagcgatcagtgttagcagtggtaatgagcctagtattagtgacggtgctggctgcgtgtgggaagcacaatagccagtcttctggtaatggcaagtatgcaagtagtcaggttttaaacttgtcgtaccctagttcattggattcaatcgatatttccaatatgtcgggatatggcagtacgggtaatatttttgaaagcttataccggttaggaaagaatggtagcattacaccgggattagctaagtcaactaaggtttcaaaggatggcaagacgtatacctttacgattcgcaatgcaaagtggagcgatggttcgaagataaccgcgcaagactttgtctattcttggaaacggaccgtcaccccagcaactaagtcacagtatgcctacctcttctcaggggtgaagaatgcggatgaaattgtcgctgggaaaaagtcaccaagtacattgggcgtcaaggcgcaaggcgaacatacttttattgtgactcttgataagccaattacttattttaagaagttaatgacctacccgttgtttggaccaattagtgagaaagcggtcaaaaagtggggtaataaatatgccactaaggctcagtacatgctctacagtgggccgtttaagttgactggctggactggaactaataatagctggcagtttgtaaaaaataatcagtactgggataagaaagctgtccacctacaaaagatcaactacacggtcaatgagagtactacgacaacattgaacttgttccaagaaaagaaacttgatctaacgcaattagcgagtgaacaagttaagaatatgaagagcagttctgactataccacgtacccttattctatcaccgcgtttctggtttataatttccaagacagtaatgcgacaatcaaaaaggcgctcaataacgctaagattcgtcaagcaatttcattgtcgatcaatcgcaagacgttagtaaagaatgtgattggtgacgcatcaacggtctcaaagacgtttgttcctcaggatttagttaaagacgctaaaactggtaaggattttgcagatgaatcaacggttaagaattcaacgtcatataacaaagcgctggcacaaaagttatggaaacaaggccttaaggaaacgggaattaagaaattgtccattcagttattagcttctaatgacgaacctaataagccgatttcacaatacttgaaatcagcattagaaaagaatctcgatggtttgacggtcaacttatccaacattccatcaaaggtagcttcaagtcgtgctcaaagtggtgattttgacctttatctcagtggttggggtgctgatttcaacgacccaatctcgcacttgcaaattatgactaataatagtggttataattacggaaaatataacagcagcacgtacaatgcgttggttaacaaggctcaaaaccaggatgccaatgatactagtgctcgttggcaagatatgattaacgctgagaagacgatcatgaaggatcaaggaattacgccattgtatcagacggtatactcttatttacaaaatccaaaggtaaagggtattattcataatactgctgggacacagtggaattataagtatgcttatattgccaaataattaactgattgagggacgttcatggtaactggtcgtttagctgttaccttagtaggagcgccaggtccatacgttgccttgatcaaaacaaaatagcggtccatttcgacttgtcagagtgtcttgacgaatcgaagtggaccgcttatttatttcgacgaatggttctacagtgcttgagttgtcacgcaagacaactacactgattggtctatgctggtgttacgtcgttaaccacgtacttgattggctgatgttgggccatcgcaatcacattctccgcgacaatggtagccatgccatcgcgagcttcgaccgttgcgttgccaagatgaggtgtcaaaatgacgttgttcatcgtggccaaaccaggtgtgacttgcggttcatgttcgtagacgtcgagtgcagcgccagcaatttgatgttgttgcagcgccgtcacaagtgcttgctcgtcgacaattggcccccgtgcggcgttgatgaggagcgccgtggacttcattttgctaaaagcagcattatcgattagatgcgttgtttgtgtggtaagcggcagatgtaaagtgacgatgtcggcacgctgtaaaagttcatcctgggagacaaaggttgcgccaagttgcgtttcacggctaatcggtaggcggtggtgttggctgtataagatgggcatgtcaaaggcgtgtaatcgtttggcaacagcttgaccaatttggccaaggcctaagatgccgagtgtcttgccttgtaagttgtggccgagaaagaacagtggcgcccaaccgttaaagccgctagttcgcattaagtgatcgccttccacgatacgatgcgctaggctgataatcaaaccgaccgttgattcagcggttgcgaccgccgaaacgttcggcgtgttcgtgactggaatctggcgcttagctgctgccgcgatatcgatgttattagtgccagcaccaaaattagcaatcagtttaaggtgtggggcgtggtctaagacatcttgatctacttgagttgagagtggggtaatcaaaaagtcggcatcagcgactcgacggatgagttccgcgtgactgatcaggttatcgccggtataagtatcaatgactaactgactttgtaaaagtaacgtattagcttgggctggaagctgaccagcaataaagacttttgtcattatagagactcctttttacttttaagttcaaggacaagtaatattgtccgggtagtaatccctgcttatgtgcagtatgggctattgcaaaacgaatgacaagaaaacgagcaaaaaaactgggccaacgtctagttagcccagtcaaagatattagcttattttaatttgttgttttccataatatcatcgatcaaaccgtagtctttagcctcttgtgcgcttaagtagttatcacgttcagtatcatggttcaacttttcaacggattgtcccgagttgtcagctaaaatctggttgatctttttacgagtcttcaagatttcttccgcaacaatttcaatttccgtttgttgaccttgagcaccaccagatggttggtgaatcaagatttcagagttaggtaaagcaaaacgcttgcccttagtaccagatgaagctaagacgctggccatggaagcagccatccccataacgatggtttgaacatcagatttgatgaagttcatcgtatcgtagattgctaagccggcagtaacgacaccacctggtgagttgatatagagatagatgtccttacctgaatcttgggcatccaagaagagtagttgggcaataatggcgtttgccatgttatcttcaatgggaccggataacataatgatacggtcctttaatagtcgtgaatagatgtcataagcacgttcgccacgtgatgactgttcaataactgtaggaactggatacatgatttgttagcctcctaaggttgcattatttgattagctgattgctaatataaatgtagtttaccgctaaggtcagtgaaggtcaaaagaaaaacctcaaaaacagaattccgtttatgcagttaacgtggtatacttaggtttctatcataatacggcttgagattgggtgaacccaatctcttttttttcgacgattttagttagtaggccttggattaagtgttgcgtctaccttggcttgaaaacgatgttctcttataataatgattcaagattaagcagtaatgaacttgcatattcagcactaatgtggtgatttaaaagtagtcgacccgcataattttattatcgcgatagtaggtgaatcaatttactgatagtgacccacaacgatgagtctaatagaagttggaaattcgcacgtgagccgacatattaaacgacttgaccttgttgctggactcaagttgctcgcaacgaattaatcagtatcggatgcatgaatgaaatttaccatgattaaaacgattctataatataataacaattgtagtaattattatttgaatagtgtaagtttagctgttattaaatctactaaacgactacactggtatatggtttacttgaactgattactttttgattatttttacttggacgagcgggtataggtactattactgaccccgaaaggatattacttgttgtttggtttaaattaagttactatatggagatgtgactggtatagtccagtagttgtcacttgaataaatgcacaaaaaaagctgagaatcatttctcagctactgatgcgcccggagggaatcgaacccccatctcaagaaccggaatcttacgtgctatccattacaccacgggcgcctaaacaacatattatattctagcgaataatggataaaaacacaagggttttacataaaaatttattcagggaggtatttttatggcactgggaccaggatttcgccagcaacagcggcaatcacagaagttagcgatgactcagcgactacaacaatccattcagatgttgcagtttaatgtggaagaactaagagattttctaacgcaaaaagcattagaaaacccattgatcgatgtggatacaaattggaataataatcacgccagtttgaacgcagccaaaaatgtaaccactaaggcggatttcattgagcgtgtgtcgacctctaatcagcattcgttatttgaatacttgttggatcagattcacctaacgatgcgtgatacccatttgcgtcagattgtcctttatttaattgagtacgttgacgtgaatggttatttgcggattgatgagaggcaggttcggcaagaaactaaggcaacgccaattgagttgttggatgcaattaccttattacaacaacttgatccgccgggtgttggggcccggagcttgcaagaagcgctgatgttgcagacagaaaatgatgaccatgcaccgaacttagcctatattgtcttagaagaaagttttgacgagctggttaatcgacaatgggacttgttggctaagaagtatcaggtgacgcttgcggacatttcaagtatttatgattatgtgcgaacactaacacccgtacccggtgcggcaatcgggcaggagacgaccgggtacatctttcccgatttagtggtgacgaatcagggaggccagctggcattgcgaaccgcatccatggctcaaccggtggttaaattccgcagtcggtattatcagcagatggggcagcatgatgatcaggaagttacggaatatttgaaagaaaagaaaagtgagtatgactggattgctaacagtttgcagcaacgcgaggcaaccatttttcgagtgggaacggccattatcgagcgtcaagcagacttcttcttggaaaaaacgacggatttacggccactattgttacgagatgttgcccaacagttaaaagtgcatgaatcaacaatcagtcgaagtattaatggaaagtacattcaaacggacttcggtatgtttgaacttaaacgtttctttaccaaagcggtcagtaaacgtcccactggtggcaaaatcgtttcggccgacagtgttcaacaccgaattgtgaccctgatcgaacaggaaaataaagaaaaaccgctttcagaccaaaaaattgttcagattcttaatgcggaaaatgtcgaactttctcggcggacagtggcgaaatatcgcgaaaatcttaatattccgtcgtcatcaaggcgaaaacaatacttgagaaccgaacgataatttaacgcgccttttggaccagtcggttataagtttaattggggtttcatttgcaaccaccttatgaacctgttataattcatattgtggtaagagaggtatgcaacattgatttcttagtgaatttgcgttgtgtgctttgttttttgaagtctttgggtcgcttttcgacatagctggaccagacccgtcccactagagagcaggttggatgccatgcattcagatattcaatggattgaggcaattgccccagatatggttgacatgctgagtcgtcgttacttagtattaagaaccattaattggatggccccagttggacgtcggctattagctcagacgttaggtgttagcgaacggacgttacggaccgaaacggatacattgcggaagctagatttgattatgacaaacaaatcgggcatgcaagttacccagcaaggtcaagatgtgttagtaggcctaagtcattttatggatgagctaatgggcattcgccagaaagaacgacagttggcgcaatactttaatattaagcgttgcatcatcgtttctggtgattccgatcgacagttgaaagttattgggaccatgggcgaagaagtgaaccagctattacagcaattattgccggaagggcgtaatattattgctgttatgggtgggcataccatggaacatgtggcaagtcacttaactaataaattaggtgataaacgtgatttgttatttgttccggcgcgtggtggtgttggtgaatcggttgcgattcaagcaaataccatcgcgtcacaaatggcacaacatactggcggtaagttccgctcgttgtttgtaccagaacaggtcagtgaacgaacgtatgaaccactcctcaaagaaccaagtattcaagaggtgctggcgattatcgggcaagctgacgtggtcgtgcatagtatcggtgaagccatttcaatggcccatcgccggaatatgtctgaggatcagatcaaggtgttacgcagtcgtgaagcgattggtgaagcctttggttacttctttgataagaagggtaacgtggtctaccgaattccacggattggtttgcaaatcggagaactggcccatcgggagattatactcgccattgcgggtggggcttcaaaagccaccgcaattgccgcgtatatgaagaacattgcacctaaacagacgtgtttgatcacggatgagggtgcggctaacttgattttaaaaaagtaatcttctatagtgaagttgctttttaaaataaaactatttttatttccacaaggaggaaattctagtatgtctgtaaaaattggtattaatggtttcggacgtatcggtcgtttagcattccgtcgtatcttagaacttggtgaaaagtcaagtgatatcgaagttgttgctattaacgatttaacttcacctgcattgttggctcatcttttgaagtatgactcaactcatggtactttgaacgctgacgtttcagcaaccgacgattcaatcgttgttaacggtaagaactaccgtgtttatgctgaaccacaagcacaaaatattccttgggttaagaacgacggtgttgacttcgttctcgaatgtactggtttctacacttcaaaggctaagtcacaagctcacttggacgctggtgcaaagcgtgtcttgatttctgctcctgctggctcagacttgaagaccatcgtttacaacgttaacgatgacatcttgactgcagatgaccgtatcgtttctgctggttcatgtactactaactgccttgcaccattagcattctttgaaaacaaagaattcggtatcaaggttggtactatgactactatccatgcttacacttcaactcaaatgttacttgacggccctgtacgtggtggtaacttccgtgctgcccgtgctgccggtgtaaacactattcctcattcaactggtgctgctaaggctcttggcttagttatcccagaattgaacggtaaattacaaggccatgcacaacgtgttggtgttgttgatggttcattaactgaattagttgctatcttagacaagaaagttactgctgacgaagttaacgccgcaatcaagaagcatactgaaggtaacgaatcatttggttacaacgatgacgaaatcgtttcatctgatgttatcggtactactttcggttcaatcttcgatcctactcaaacagaagttacttctgatggtgacaaccaattagttaagactgttgcttggtacgataacgaatacggcttcacttgccaaatggtacgtactttattgaagttcgccactctctaatatttgattagatagttaagaactttaaaaccgcatatggttttgacggcggggggaggcaaaactcctcttgccgtttttttaatttcagcagtcacgaattctaggaggattttaacattggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtacctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataatctgttctccgaaaggaaggtttatcgtgcgtacacctattattgccggtaactggaaaatgaacaaaacagctagcgaagctttagctttcgttaatgctgttaaggatcaattaccagatccatcaaaagttgaatcagtcgttgctgccccagcccttttcttacaagaaatggttgaagctgccaagggttctgatttaaagattgctgctgaaaatgcttattttgaagatgctggggcatttactggtgaaacttcaccagctgccttagctgacttaggcgttgattacgttgttattggtcattcagaacgtcgcggttattttcacgaaactgacgaagacattaacaaaaaggcacacgctatcttcaagaacggcatgaagccaatcatttgctgtggcgaatcattagaacaacgtgaagccggcgaagcagaatcatgggtttcaggccaaatcaaggctgctttgaaggacttatcagctgaccaagtaagttcattggttattgcctacgaaccaatctgggccatcggtactggtaagactgctacgagtgaccaagctgaagaaatttgtgcggttgttcgtaagactgttgctgacctttactcacaagaagttgctgataaagttcggattcaatacggtggtagtgttaaaccagccaacgttaacgaattaatgggcaaagatgatatcgacggtggtttagtcggtggtgcttcattacaacctgattcattcttggaacttgttaattaccaaaataactaataatagttattgcaagttgattgacaaacttctacaataagtgtgaaacaaataacaagccaattttaaggagagaaattaatgtctattattacagatatttatgctcgcgaagtcttagactcacgtggtaacccaactgttgaagttgaactttatactgaaagtggcgcatttggccgtggtatcgttccttcaggtgcctcaactggtgaacatgaagccgttgaattacgtgacggtgacaagagccgtttcatgggcaagggtgttactaaagccgttgacaatgttaacaagttaattgctaaggaaattgttggttacgatgtaactgaccaacgtgccattgaccaagctatgatcaagttagatggtactcctaacaaagctaagttaggtgctaacgctatcttaggtgtttccattgccgctgcacgtgctgctgctgacgaacttgaaatgcctttatacaactaccttggcggattcaacgctcacgttttaccaacaccaatgatgaacgttatcaatggtggggcccacgccaacaacgatgttgacttccaagaattcatgatcatgcctgttggtgcttcttcagttaaagaagctatccggatgggttcagaaactttccacaacttgaaagcgatcttgaacgaacgcggttactcaactgctgttggtgacgaaggtggttttgcacctgacttgaagaacaacgaagaaccattcgaaatcttagttgaagctatcgaacgtgccggttacaagcctggtaaggatattgccattgcctttgactgtgccgcttcagaattctacaacgaagaaactggcaagtacgacttaaagggtgaaggcgaaaatggtcaatcatttactgccgaagaattcgttgatttacttgacagcattgttgacaagtacccaatcgtttctatcgaagatcctttggatgaaaacaactgggaagactggcaaatggcaactgccaagcttggtaagaaagttcaaatcgttggtgacgacttattcgttacgaacacggactaccttgcaaagggtatcaagatgggcgttgctaactcaatcttaatcaaggttaaccaaattggtactttaactgaaactgttgaagctatcgaaatggctaaagaagctggctacactgccatcgtttctcaccgttctggtgaaactgaagacacgaccattgctgacttagttgtcgcaatgaacgctggccaaatcaagactggttcaatgagccgtactgaacggattgctaaatacaatcaattaatgcggatcgaagaccaacttgaaagcacttcagaatacaaaggtatccacggtttctacaacttagacgaagctgcacggaacaccattactagcaagtaatttgaagttctaatgaaaacgtcgttccgatgggacggcgtttttattatacataatttaaggaacatctgtttgagtttagggtctagggacggacgagtcgtggtagaatagaaacatgcgtattttgagtaaggagcgagcagaatggatgactttcagcaacaaattaatgagtggtctgattggcaaggactgcaactgaatgccggtgcttttgaaccggtgattcaaaaaatttatgccagtgaaaatgagccttataaaacgccagaacccgttgcggataagttggccgcccgctttacggtcggacccacccaaatcgcgatttttccacccagtgaggttatcccccaaactcgggcctattatcaggcggaacgttttggactgacccggatggctcgattgagcttgggtgctccgcgtctattgcatgcgggcttcatttttgataagtaccagttctactacgtgatttatcagccactacaaggtctgacgctaactgaattttgcgcaacggctaagccccttgctaagtcaacactggggcgccagattgggacgatgttgacgcgacttaatactgaagttcctgcatttgggccaaccgctgcccaatcaaccgagtgggatacactgggccccgactttgttgccgagcgtacggcctggctacaagtacacaccgtaacgcctaatcaatttgttcatggcaatctagtgggcgagaatttaattgtgactagtggtgaattaggtttacagcgattcagtgccgcccatcaagctgcaaaacaaacggaattagtcccgctaattttgcaagcatttaatgatgatactgacttattggctggatttaaggaaacttatcaaactgacgacttagaaaaggatctgttattaggtttgttattacgcgtagatggaccacagcagattcaggcattacatcctggagcgcccgtgacgttagcggccgtccagcaagtgattgcacaacgattatcatgattaagagggggaactcatggtggcacagcggccgcacattgcaaaacaacattttgactttacacggttcagctcgattggccgggcattaattgtcggtgtgattgctgggatcgtggttagtatttttcgtttcagcatcgagcagggactgaggttcgttcaatgggtgtacgcacaaattcatacaaattggctactgctctttccatggataggcttgtctgtggctgtggcgttctttgtgggttggttagttaagaatgaaccgaatattaaagggtctggcattccacaagttgagggtcaattagctggcgagcttgattatagttggtggtcagtgctctggcgcaagtttgtcggtggtattctgggcattggttctggactgtttctcggccgcgaaggcccctcgattcaattgggagctacgattggtcagggtgtcgcgtcgaaactcaaacaaacgggatcagatcgacgctccttgattgccggtggtgcagcagctggcctttcagcggccttcaacgcaccgattgccagtacgttatttgttctggaagaggtttatcataatttttcaccaatcatttggaccaccgcattagttagtgcgatggccagtaattttatttcgctcaatttttttggccttgtaccagtattacacattccgtacggccataaccttccgttgagtcaatatggcaatctgattgggctcgggatttttctcggtattttcggttatctatatcaaaacgtgacgctgacgatgccaaattggtatgccaagttgcggttgcccagttggttggatggcttggtgccatttttactggtgattccgattggattaatgtggccgcagctattaggaggcggcaatgctgttattttgaatttggccgcggtaacgccagcgttactcgccttgttaggaattttcgtgttacgatttaccttttctaccatttcatatggttctggtttgccggggggcatcttcttgccaatcttgtcactgggcgccatcttaggtgcaatctatgcccagttcatggttgccgttggttggatgccgacgaacttgattccgaactttattatttttgcaatggctggatactttgccggcattggtaaagcaccgtttaccgcaattttattgattactgaaatggtcgggacactacatcacttgatgccattagcagtcgtttcgatgacggcctacttagtcgtggatctcttaggcggcgctccgatttatgaggctttgctagagaagttaattcagccgcggttaccggaacatagcggtatccaggatcggttagaattgccgatctttgaaggctctaagttagagggccatcaagttcgtgattttaaatggccagcagagtcattattgattgctattcgccgcggggagcgtcaagtgatcccacatggcgacaccttaatgcgggctggtgataccttaattattttgactgaccgggataaccgtgcgtgggtgcgtcatcaaatcgcacatttaacggtcgcgacgccctgagcgctgaacaaagcaacgaattgttcaggatactggaaaaataaggcaaaatatgttaaattgttatagacatagcggaggctttaggaggcacatttcttgtataatttattgttaacgttaatactggttgtttccgttttgattatcattgcggtgatgatgcaaccatccaaaactaatgatgccatgtcttcattaaccggtggtgctgatgacttgtttgccaagcagaagccccgcggttttgaagcgttcatgcagaaggtaaccgtggtattaggaatcgcattctttatcctggcgttagctctagcatggtactcatcgaagtaattgaccgtcctcctgtgatttcaggaggcttttttttaaggtggtgtaatgatgctgaaacaaccggaaccgtttttctttgaacatggccaacatgccgtcattttattgcacgcctatgcgggaagtgccaatgatgtgcggatgttagcacgagcattagaacgggaagattatacagtttatggcccccaattcagtggacacgcgactgatgatccacgagatattctcgcacagacgccggcgcaatggtggcaagatacgcaacaagcaatatcatttatgcggcaaaaaggctatactaaaattagtatctttggcttatcattaggtggtatttttgcgacggcggccttggaacgtgatcctcagttgctaggtggtggcacgtttagttcaccactatttgctggtaatcgtagtgacgttgctgaaatgtttatcacgctgagtcaccatcaactggcgcacagtcaattctcaattgccgagcgtgaacagatcttaatgacgttgccggaactggttcagcggcaattgcaggcagtcaatacctttactacgacagaggttacgagtcacatcagcgctgtgacccaacctttcttcattggtcagggtgggcaagatgaattaattgatgcgacggtggcgcgacaattacgtgatcaattaccacaagtatcagttgattttcattggtatgctgatgctggacacgtgattaccgttaacagtgcgcatcaccaattggaacaagatgttttaacatatttaaaaactatttataaatgaggtaaataatgtcagaagcaaacttacaagaacaaatcctgacttttttgcaagctcatcccgatcgcacgtatagtgttgaacaactaacggatgaattgcattttacaggcgcaacggcgtttacttttctagtaaaggaacttgcgaatatggaacgtaaaaaattagttagtaccgatgatcatgatcatttcaagctggtccaggaaacgaagactgttgaaggttcatttcatggtaatgacaagggctttggtttcgttcgttacgatcccgatttgcctgatatttacattaatccggacaacacgcagtttgccattaccggtgacgatgttgcggttgaaatcattcgaccagcccgtcccggttccgaccgcggccctgaaggtaaaattgtcagcatcgttaaacggaactatacccagattgtcggtgcgtatacaccaagtacggatgaagacgggattattggttctgtggaaattaaggataagaaattatccaaatatcagttattaatcactgatcagggcttacaccccactgagggggaagtcatcatcgctgaagtggctgcttatcctgacgctcagcatccaacgcggatgattgggattgccaagcaggtcattgggagtgttgatgatcctgggatggacgtcttacaagtggtctaccaacacgacgtcccatcagtgtttccagaagaagtgacggatgaagccaaccggattccggattacgtgactgatgaagaaaaagttggtcgggtcgacattacggaccagccattagtaacgattgatggcgccgaatctaaagacttggatgacgcggttgttgcttggcgcttgccaaatgggaacttccatctaggcgttcacattgcggatgttagccattatgtcaccgagaactctgagttagatcgggaagcattcaaacgtgggacgtcagtttacttaactgaccgtgtgattccaatgttgccacggcggctatcaaacgggatttgttccttaaatcctgatgttgaacgattagccatgagttgtgagatggagattgatcaaacgggggaaatcgttaaccataagattttccaaagtgtgattcggtcacatgcccggatgacttatgacgctgttaatcagattctcgaagcccatgaccccaagacgcgtgaaaagtacgcggacttggtcgacatgtttgatacgatgggcgacttacaccgtatcttgtacaagcatcggcggcatcgtggtgcgatcgattttgatgataacgaagctaaaattatcgttgacgaagccggtcacccaattgacattcaattacgggtacgtggcttagctgaacgaatgatcgaaagtttcatgttggcagccaacgaaacggttgcaaaaaactatagtcaacttaaggtaccgtttatctaccgggtacatgaaacgcctgatagtgaccggatgcttagtttctttgaattcgtcactaactttggtgtcagtgtcaaggggagttctaaggatgttaagccgaagatgcttcaagacgttttgaagaaggttgctggtaagcccgaagaagccatggtctcagtcatgatgctgcggagcatgaagcaggcccgatacgctgaccagtcgcttggtcactttggattggcggcaccgtattatactcactttacgtcaccaattcggcggtatccagatatgatggttcatcgtttgattcgccattatgctgaaaacggcactggtgaagaagcccgggcacgttatcgggataacctaccaaatattgcggaaacgacttctgatcatgaacggcgggggattgatactgaacgcgacgttgattcgatgaagaaggctgaatatatggctgatcacgttggtgagacgtttgaagccgttgttgattccgttatgaaattcggtctgtttgttgaactagaaaataccgttgaaggcttagttcatatcagtacgatggacgacgactactacgaatacgttgaaaaacaattagcgttggttggccgtaagacgaaacggacatttagaatcggccagcccgtcaaagttcaactaatgcgggtcgataaggatcaacgagaagtcgactttaagttattgaatcctgaagaagcgccaaagactgatttattgccaaagcgggaacatcatgataactatcgtggtaataaccggcgtggtggcaataacggtaactaccggcgaaatgggaacaataataaccggaataacgaccatcgtggtggccacaacaataaccatcgtaatggcaatagcaatggtcgccggaacaataataatcataatagcaacaataataatcatagtactaacaacaatcggcggtcatcaactgatcgtcggcgttaatttttaagtaaggggatgtgcggcaatggccaaacaacacggtaagcacccagataccgccctcgctcaaaatcggaaagcacgccatgactacgctgttgaggaaacctatgaagctggcattgcgctgacggggacggaaatcaaatccgttcgcgatcggcgggtaaacttaaaggatggtttcgttcaagttcgcaacggtgaagcctggatgcaaaacgttcacattagtccgtttaaagagggtaaccgttataacgttgacccgttgcggtcccggaaacttttgttgcacaagaaagaaatcagtaagctaggtgcagcaacgatgactaagggtgtgacgattattccacttaagatgtatctcaagcatggatttgcgaaagtcttaattggagtcgctcacgggaaacgggaatacgacaaacggcaagatatcaagaaacgcgaacaacagcgtcaaatcgaccgggttatgaaacattactaggcatcgattacgttagcgttgcatcgctgcaccatacaacgagtatggcagcgtcataaaaaggtcttccaagaattaattcgattcttggaagaccttttttagtatgtgttgttggtggttctgtgccgtggacggacgacggcaagcatatattttatatgtactgatgtagtgctcactgttataaatgttctagatactagcaaaatggttatcaggctataaatattttgcgaaaggtcgggtacaagcacttgcgacttagctggtaattatgttagcatataattgtattgatagttaaacgcgttatttattaattgattcaataaatataattgatactaaactttggagaatgttattattctgatattaatcagatttagtataactcaaattgataataagttaattttgatatgatttattgcatggattcttggggggacatgtatgaatagatttataacgagcaagcagcattataaaatgtataaaaagggacgtttctgggtatttgctggtattaccgtggctacctttactctgaatccactgataagtcgggcagatacggaaacgacgaccgcagccaccgcagctacgaccactgctggggcatcctcatcatccaactcacaggttttaaggactactacgactagtacaacaggggcaacgactcagtctagtgcgacggcgattaatgcggcaacaacaaatactagtgctcaaaaaaaacaggcggttagtggcaccactactgactcaaaggctgaacaaccggttacggcagtaggagaaaatgaaaacgcaaccagtaatctcagtacctctgattcggcatcagcaagcagtcaggctaaaactggttctggcgacagtttggaccaaacgtcaaacagctcagtaagtgtcgcatcgagttcacagaaagtcacaacacaaaattctgattatcaaaatgatcaaggaacgggctctgagagtggcattcaatctaatgtgacggacacggtggtggctgatgaatcactacaaactaatcgttcaagtgtcgcatcgccaagtactagcacaatggccagtattggtgactcagactcgaaagattctaatgaaactgaaaaagttgtggattcagaaactagtccgatagctgtaactgccacaactaatacaattacgacgactaacgataaagtccagttaaatcgggcactattagcgcgagccgccacacccgcaattgttgtctcaagtgggactctgggaacaagtgcctggcagtacacagatgatggtgtgttgacgattcatgctggtgattggaccggagtgggtgatgtcagcgacgtaccgggggattttggcagtgagttaacgaaagtagtgattgatggtccaattaatgcggggactgatactagttatatgttccggtataatccaaatttggccagtattgatggccttgaaaatctggatacttcgaaagtcactgacttttcaatgatgtttatgggaactaagattgctgacttctcaggattagcgcattggaatgtcagttctggtacgtcctttgactctatgttcgccagtgactcgcgagttcaatcttatgatttaagtcagtggcagttgaatacgattcaaccagtgagcttaaaaagaatgttttcatttaacacggccttgaccagtattgatctaagtacttggaatgtgcggatggtcacggatatagatgggttattcaatggagataagagtttaacaacggcggatttacatggctggaacttgttgaatgttacagcgttgtcatcgatgtttttaaatgataccaatctcactgatcttgatataacgggctggcagacgggcagtacgttaactagtactaagtttatgtttgagggaacccctggattaaaggcaatcaacattgcgagtttggacatgtctaactttgcagcagtcactgaagctgatatgaataaggaacctgcagatcatgatatgtttttgaatcaagatagtagcgggaatccgttgcccatgaacctaaacgcattaacggttgggtcaaaaacatatttagtcggtagttcattgccagacattccaactggaactggctataccggtaaatgggtcaatcaagctgatgccacccagacgtatacgtcgagtgagttaatggctttgtataatggcgtcgataatccagccgatacaatcacttgggtctgggaaactagcccatcctatgctgatttcacgtccaagaatgtaaccggattaattgccgggccgaagacgacgtggcgagttgccgatagtgttgcaacactaaaagatgtgaatgggactgatatttatgcgaccgctgacacagtcgtcaaattgattagcgtgaacggcgatactgctgtaacgacggtcgacactcaaactgccggtacctatcaagttgacttgcagtatacggatgcgtatggcaaagtatggcagcaaactagtacggttgcggtagcggtaaatcaaggcaaactagttggtaaaccgttggcgatcaaaatgggtgctaagccaacgtatacgattaatgatttaatcgacacggacaactcccgcaatgcggccggcgataagctaagtgctgacgaactcgcgacggctacggttacaggcttggatacgagtaaagctggcgcacaaacggttacgctggcgtatacggatgatgctactggcatggtccacacgacaaccaccacggtgacgatggtcgcaactaaggccgacttaacaatgcgtaatagtactatcattaaaggacccaaaaactcaagttgggactaccgccagtatgtcacgagtgtcactgattttgatgggaacccggttagtttagatggacttaacattgtggttgatcagcaacctgatttaacgcaaattgggtcgcaaactgtcacactcacgtatacggatgcgttgggcaatgtcatcagcgtcccaactcaagtaacagtcgttgcttctcaggcacaagttacaaccaaggcgccgttaacgatttggcccagtgaggttgctcaattaaaagtcgccgatttggtgacaatcacggctgccaacgggaaccccgtcgatactagtaccaacctaacagatgtcacaatgagttcaattgacacgagcaagggtggcgcgcagaccgttactattacttatacggatgaagctggcaatctagtgacagcttatgccaaagtaacggttgaccaatcagatttgaagaccaagctaacgaatccaattgcggggcctaaagctaaatgggactatctagctggtttggaatgggtcaaggatgcaaatggaaagttgcttgataatctcgcaaccgctgatattaaagtcgttactgaacctgatttaagtgttgcgatggtcggccatgaccaaacggtgacactcagttatacggatgagttgggcaaagaacacttagtcactgcggttgtcaacacggtggcttcgaaggcgaagattacggctgtcagcgaccagatcatcatacctgatgaagccaaaaagctgacggcaaccgacctggtcagtgagttaattgatgcggcgggaaataaagccacgaattttgacgatgtgacgatgagtggttttgatgctaaagctatcgggccacaaaccgtgacactgacgtattcggatgcgtatggtaaccaaacgactgattcgacgacagtcaccgtggatttggccacaatcactggtcaagcgacacacccaattgccggtccaaccgcgacttgggattaccgtgacagcgtcactcaagttatcgatgccaacggaaagataattgatgtcggcgatgctgacattacagccacgacgccggatttaactccggcaaaggtgggcaagcctcagacggttacgttgacctatactgacagtctgggtaaagttcacacgaccgacgtgattgtaacgacgacgctttcaaaggcgaaaatcacggctgttgctgaccagattatcatacctgatgaagccaaaaagctgacggcaactgacctggtcagcgagttaattgatgcggcgggaaacaaaatcacgaattttgatggtgtgacgatgagtggttttgatgctaaagctatcgggccacaaaccgtgacactgacgtattcggatgcgtatggtaaccaaacaactgattcgacgactgtaaccgtggattccgcaacgctaacgcttcagaatcacactcaagtggcaggacctaaggcgacttggaattatgctgataacatcaaagccatcactgattctaagggccagtcgctaacattaagcgatgccaagattacggtcgtgcaacgtccagatttaagtgtggctggaacttataaaattgtacttgaatatactgatgatttagggcaagcgcacacagagactgccgatgttgaagtgacggcttcaaaagcggccattactgccgtttctaagcaggtgattttggcagaaaaagcgaccatggtaactgcgtcgtcactagtgtcgacactgtacgatgcggatggcgttcaaatttataattttgatgatgtgacgatgagtggttttgatcctaaagctatcgggccgcaaaccgtgacactgacgtatacggatgcgtatggcaatcagacgactgctcagacgactgtcaccgtggatttggccacaatcactggtcaagcgacacacccaattgccggcccaacggcgacttgggattaccgggacagcgtcactcaagtcatcgatgccaacggaaagacaattgatgtcgatactgctgacattacagctactacgcctgatttaactccgacaaaggctggcaagccacagacggttacgttgacctatactgacagtctgggtaaaattcacacgaccgacgtgattgtaacgacgacgctttcaaaggcgaagatcacggctgttgctgaccagattatttggcctgatcaagctaaacaactgacggcaacggacttagttgatcgtttatacgatgctgaaggtcatctgattacaaatcacgacaatgtcaaaatgagtgtgctggattccaagttagcggggcagcaacgtttgacgttgacttacacggatgttgcgggtaatcaatccgtcgcgtatgccaatgtgacagtcgaccaggcaaagctagtgacaaaaccaagtacggtaattgccggcccgacggcaacgtggagttacgaagccggtattagtcagttgacgaatgcagctgggcaacttattaccgtccaaccggggacaattaaagtgttgaacaggccagatctgaatgttgattcagtcgggcaacaacagctgatcacactgatttatacggatgagctcgggaaatcccagtcggtcacggcaatggtgacagctgaggcctcacaagctatgttaacggccaaggcggcagttatcgtgcaaccggatgccgcggcgaagctaacggctaatgaccttgtaacgagcttaacggacgcctctggacaacaggtgactgattatcaaatcgttcggatgtctaagctagacgcgacctggccaggtgttcaacccgtctcattaacttatacggatgcggctggtaacgaagtaagtaccgttgtaaaagtaacggttgatcaggccaagattgatagtcagaaccggactcaaatctgggggccaagtatgacttgggattatcggcaacaattggcgactgttacggattcgcaaggccaccagtttaatcctgatcaagctaagattacggtcataaccggcccgcaactaacggctaaaatgatcgataagccgcaaacggttaccttgatgtacacagatgatctacaacagacacatactgtgtcagctactttgaccttaacggcatcacaggcggcactcgtgccacgtccggcacagattgtatgggccaaagatgcggggctactgacgccagccaactttttgcaaacgattaccggcgcagatggcactcaagtgtcgtctttgaccaatgtcaagatgagtgcggtcgatgccagccagcctggtgcccaaacggtgactctaacgtataccgatgattacggcaacgaggtgacaacaactgcccaagtgacggttgatcaagccgccttaacgacccaaaccgctcgaccggttgccgggccgactgcccattgggattatcagacgaactttaaaaccgtgacgaatgctgccggtgaagtgattaatgtcggtgatgccaatcttaaagtcttgacaggcccggacttgagtacagccatggtggggcggcctcaagtcgttacgttcagttacactgatgaattaggattgacccaaaccaccacggcggaggtcacaacagtcgcctcacgggcgcacatgacgactagtgctgatcaggtgatctggcctgcagttgtcggaaaattaacggttgcggatctagtcactggtttaacggacgcctggggccagactagtcaaaattatcaaagtgttacgatgacgaccatcaatgctcaacaggctgggaaacaacaagtcaccctgacatatactgatgaggtgggcaacgtaaaaactgcgactacgacggtgacagtcgaccaagcagcattaacgactcagccacaaacggtcatcgcgggtccgactgccaagtgggattatcatcagggtattggaacgattactgatggtatgggccagccgattgcggtcaataatgccgctattacagtcgtggcgatgccagacttaacggttgcccatattgggcagccacaaactgtgcaactggtttacacggactcgctgggacaacaacaaacggcgttggtccaagtgacaaccgttgccacgcaggctaaaatcagtacgcggccagttaccgtgattgccggccctaagacgacctggtcactgaatgatagtgttgactggtcaacgagtttggcagcggatggcacgttgctgacagcggcgcagcgccagcgggtgactgtagatggtgccttgaacttacggcgggccagcaattacccactgacactaagttacatggaccgtgcgggtaatttgattactgtcacgacgagcatcaatgtattggctagtcaggcccagctacaagtgcgtgatagtcagttgaccgttggaaacgcttggactgctcaggataattttgaacgtgcaaccgatgcccagggccaagcactgacattagccgatatcgcggtcgatggtacggtcaacacgcaacgcgctggccagtacacgttgacttaccactatactgatgttgccggtaatcagttaactaaaacggctgtggtgaccgttgtcttgccggaagatgatcacattaacacgactaaccctgacaacaatgatcatgcgggtatcactaatcctagtgaaacaccgaagccgagtgagcaacctaacgattcggatggtcataccgtcgactggggcgttgatgatcggattacgacaaagcaacaaccggccgcggctactcgtgcacagactaaggtcaagatgaccgctgagccagctctatcggccaacaatgagcgtactagcgcgaccaaagctgtgacacgagtaactgacacgactgctgacacactgccacagacgggcgagcgcgaccgctcagcacaacaaggcgcggtagtactcggattaacgggattattaggcttaatgggattaggacgtcggcggcatacgcatgaggattaagcgtacgattggcgtgttaagttcatcgattagctaaaattgatagcgatttcttgcaacggaccgattcattttgaattggtccgttttgttaactgctgctgtttggacttaacggctggttgcgcgggttgatgaatctagtgtcaagtattcagttaagcagtgattaatgcttgaacaaaattttaaaacataaaaagggggtactttcatcagaatctttgctagaaatgactatttactttattttattaagtaaacagctgatgatagcgacatcattaaagctaaattaaaaaagtataaaaaattgaattagtcgcgagacatgaattatgttatattttatgacataccgttccggtaaactatttgaggaggtctcgtcgatgagaaagtggcaagttgcagttgtcatgttgttagcagtgttgggaagctggtttgcgattggtacccaggcccaggctaagacgtatacgattgcgacggatacaacctttgcgccgttcgaatttcaggtcaagggtggtaagtataagggaattgatatcgatattttgaaggcaattgccaaaaaagaaaatttcaattataaattaaaagcgcttagtttcggtgccgctgttcagcagcttagtgcgaaccaagttgatggggtaattgccggaatgaatattacggctgaacggaagcagacgtttgatttttcagacgcttactatacttccggggtggtcatggctgtggctaaagatagcaaggtcaaaacgtttaaagatttgaaaggtaagaccgtggcccttaaaacggggacagctggtgcaacctatgcgaagtcgattcagagcaagtacggcttcaaaatcaagtatttcaatgactcgaataacatgtataacgatgttaaggtcggcaactcggctgcttgttttgaagactatcccgtgatgtcatacggaatcaagaatggcatcgcgttgaagattgtttccaagcaacacgaggccggcgactatggtttcgcggttaaaaaaggtaaaaacgcggaactgttaaagaaatttaacgcgggtctcaaagcgattaaagcggatggtacttacaaaaagatcattaacaagtacttgaagtctagtgaagcatccttaacgggtgaagacgcaagcagtcggacctttattggcttgttcacccaaaacttggatacgattggctcagggttatggatgaccttggaattaacggttatttcaattattttagcgacgatcctcggactgattcttggggtcttaggcgttatgccgggtaaacttggtccggccatctccagtacgattatttatattttccgtgggatgccattgatggtgttggccttctttatttacattgggttcccagacctgattgggcacggctttaagattcccgcgttcgttgctgggatgattacgttgatgcttaacgaaggggcctataccggagcctttgttaaggggggctttgccgcggtcgacgatggtcaaatggaggcggcccgttcactcgggttgccatactggacggccatgcgcaaggttattatgccccaaggaattcgaatcatgattccgtcgttcattaaccaatttattatcacgttgaaggatacgtcaattctatccgttattgggatcgttgaattaacccaaactgggacgttgattattgcccggaacttcgaaggctttaagatttggttaatgattgcgattatttatctgattatcattacgttattaacatggttatctaactgggttcaaaggaggattaactaagcatggcgaaagtaattgtcaaagatttgcataaaagctacggcgataacgaagtcttgaaagggttaaaccttgaagttcaagataacgaagtagtctgcatgattggaccatctggttctggtaagagtacgtttttacgctgcttaaatgacttggaagttccaacacaagggcaagttgtcattagcggttatgatctttctgagaaggggactaacattaatttggtccgtgaaaatattgggatggtgttccaacactttaacttatttccacacctatcagtgttacaaaatattaccttagcaccgactcaactcaaaaaggaaagtcaacaggaagctgagaaaacagcgcgtgacttacttgccacggtcggcttgtccgataaggcggatgccatgcctaagtccttgtctggtgggcaaaagcagcgggtggccatcgctcgagcgctagccatgcatccgaaaatcatgttgtttgatgaaccaacttcagcactggatcccgaaatggtcggggatgtgttggatgttatgaagaaattagccgcagatggtatgacgatgattgtggtcacgcacgaaatgggctttgccaaggaagtggccgaccgggtcgtctttatggcggatgggttgattcaagaaacggggaagcctgaggatgtattcgaacacccacaaagcccccggttacaagatttcttacaaaaagtgatcaacgtttaagtatcggctggtcataataaaataacccgtcaaataggcgcgctaagaattggtttaattcttggcgcgcctattctgtagtaacgtgcttgcatagcagatgaagcggtgttgctctgaggacgattaactagtgaataccgtgatatgggcaacttgatcggcacgtcaactttgatagggtgttaagctggcaaactagttatgccaacttaactaaaaacaacggtcatcccgaaacaggggtggccgttgttttatggctagttctatttagtgttggggcaccttattacggggtgtcaatgtataattactttcaccaaagctaacattgagtccctttttcgcaactggtgtccgcgcgcggttggtcggcttttgccagtgatccaggatcgccgcaatgcaaatacacagtggttctgtggattgatcagtaattgctaattcaaatgcttcaccgttagtggtgacaactggtcgcatcgtcatgattaattcagtaccatgataaacgcggtagttttcggcactcaagcttcccatgataatccagcgaagcttgcgaacatagagcatttcatgccagaagcccagcgttttactaatagaaccgacgttttgacggttatagtataaatcgaattttggcaacaatccgagggttgtttgtcgaatttcggcaagtagctcaccttggatcgcgtataaactgagcgcgtcttggcgccgcccccaccgaccaactaagagatagtgagattggttgtgcgcatcgcgaacaatccgggcaccttgggcgaagctattgcggctgaaatataatttacgcatcttcaacctccgttttccggaaactattgtttggcaagcacttctaagattgctttgccgacaccatcgttgacatttgtatcagtgatatagcgggccaactgtttgacttcgggactggcattacccatagcgtaacttacgccagctaattcgagcatggagacgtcattattattatcaccaatcgccatgacatcgctcattggggtattcagcatattcgcatagcgctcgactgcaatccctttttgcgcattaatattattgatttcgatatttgatgcggatgaagatgtgattttgagggacgaatgttttgccagaatttcatcactaaggggttttagcttagcgggcccttcttcgctgaaagcgataatcttcatgacatgcttagtcggatcatccaataactcgttatagttgtccacgtaattgatgtccataagttctaagcgggctgacgcgagcgataccgcaattttgaacgttgtatctggattcaggttagttaggagatgtgcaatttgttcgattcgcttggctttactgttagagtaaataccatcgttgcctacgacttcaaaatagtaaccttgtgaggttagcgtgtgaaaaacggtgcgggccacgctattggttatgggcaccatgtcgagcattttgccagaagcgtcgtatacttcggcaccgtttaacgtaatcaagggtgccgtgatgccttgagcggccagtagtggctgagcttcagaaaatcggcggccggtggagacgataaagtgcacgccttgctgttgtgcttgacggatggcattagcgttaaaatcggaaacgaccatttcattgttgagtaacgttccgtccatatcagaggcgataatcgaaatcatgttgtcacatccttagttgttttaataattacattctaacatgtttacgtctgaatacagaattattatcattagtggttttggttatgatacaataaaacgagaggtgttaaggatgaaagcgtttattcacacggactggtgggacgtcttaaaaccagagtttgagaagccgtattaccaccaattacacgaatttttgaaaaatgaataccgaacgaaaaatattcacccagatatgtataatatttttcaggcctttgaatggacgccatttgctgacacgaaggtcgttattttaggtcaggatccgtatcatggtcctggtcaggcacacggactgagtttttcagtgttaccgggcgtggcagtgcccccatcactagtcaatatctataaagaattgcaagatgatgttgggtgtacgcccgtcaaccacggttacttggaaagttgggccaagcagggagtcttgttattgaactccgtgctgactgttcaaaatggtgtggccttttcacacgctggtaagggctgggaacgacttacggacgttgccattcagcgtttatcggaacgatcgacgccggttgtctttatcttgtggggtaaggcggctcggtccaagattaagctgattgatacccagacgaatgtcgtgctacaagcacctcatccgagtccgctttcagcttatcgcggattctttgggtccaaaccattttcaaaaacgaacattgcgttaacatccttcggcgaacagccaatcaattggcagttaccagagcacgtcaatcttgagcattaattaatttattggagggttatcacatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaaacggtcacttagtttgttaaacgagggaaacttcagagcttgtactttgaagtttccttcgttttttctataataagaacagttaatttggatgaggagttggaagaatatggaatcaatcacggtaacgtcgccggaagcaaccatggcaatcggggccaaacttggccaattagtgcaacctggtgatttaatcttactagatggtgatttaggtgctggtaagacaacttttacaaaggggttagcaaaaagcctgggcattcctaataacgttaagagtccgacttttacgctcatccgggaatatcgtcaggggcgactaccgctctatcatatggatgtttaccgcttggaagatggcggtgcggaagatttaggcttagatgaatactttgatggtgatggcgttagtgttgtggaatggtcacagtttattgccgacctcttaccgacgacttacttgcgaattgcaattagccgggacactgatgccgatgaccagcgggtaataaccttcaagcccattggtgaacactatcaacgactggttgatcaattgaaggagtgacaaccatggcagaagaagttgttgatgtacggcctgctgaagtcgcggatgcagcacaattattagcgctactcgctcagctcggacgtgaaagtaatactttcactgttgatgagggcattgaggatttgagcgaaacggatgaacaggcgcaaattgagcgtatcaatggcacaacgaccaacattattttcgttgcgacattagattcacggttgattggtgtgagcaccgtgcaagctagtacagattttagtgcggcgcaaggtgaagttggcgtagcggtacttaaagaattttggggcatgggtctggggactgctttgattgaggaagtcttagattgggcgcgtaactatagctcattggaacgcctcgtgttgacggtccagttacgaaatgtgcgtgccgttaagctgtaccagcatcttgggttcgaaaattgtacggcaacgagctatgatgtcgttgacccaaccggcaaacgggttctgatagtagatgggccggaatttaagcgttgacgaaccaggcctaaccggcgacggcttgtgaatgattggctcatctcccagtcggttgggggaattgataagctgtctacgagtattgataatcggtagtgatgcgtaaacaaaaaagtccagcatcttattgctggacttgcataaatttaattttaaccctgaacgcgaacgaaaggtttgagttgctcagttccaaaagcttgcgcttcggtgagtaaaatgttggcgcaagctaggctgtcatctagtgcattatgatgatgctgcaggtcgatatccagtgcttgacagactgtatccagcttgtgattaggcaattctggatagaaccgttgactggtcttgacggtatccatggataggtactccggcgcgctgatgccgtagtgggcaagcgtattgcgtaacacaccaatatcaaaaggcgcgttgtgcgcaattacgaggcggtcgcgttggaagaatggtgcaatgtgttgccaaacgtctggaaacttgggcgcgtctgcgacatctgcttcatgaatcccatgaatttggacgttccgccagaaaaaatcgctctctggtttgatgagtgtgtaaaattcatcgctgatttggttattacggacaaccgttagcgccagtgaacaagcactgtcgcgtttcgcgttcgccgtttcaaagtccattgcgacaaagttcaaagttgccaccaccgtttctaaagaataggattatcgtacaaagaatctcgttaattttcaagttaatggttcggaaggataatatcgagttccactggacagtgatcagaaccaaaaatttcattatgaatgcgggcgtttaggagctgactgtctaattgctgtgacgtaataaagtagtcaattcgccaaccagaattgttgtcacgtgcatgcccacgataactccaccatgagtaaatgtcggtttggtcaggatagaaatgccggaatgtgtcggtatagcccgctgcaaggaggcggtcaaacttggtccgttcttcgtcagtgaagccggcactatggtgattgctacgccagttcttcaagtcgatgttttcgtgggccacgttaagatcaccacaaaagatcaacggcttgttggcactcaaactgttaatatatgtgagaaaagcatcttcccactgttgccgatagtcgagacgttttaattcaccgcctgaattaggagtgtaacacgtcaagacgtagtagtccgcatattcaagggtgatgacgcgaccttcgtcatcgaattctggtacaccgataccataagttacattgagcggctcgtgtttggtaaaaatcgccgtacccgaataacccttgcgctcggcatagttccagtattgataataacctgggaagtccagttcaatttggcccgcctgtaatttcgtttcttgtacacagaaaaagtcggcatcgagttcattaaaagtcgtgacaaagccgtgtttgacagcagcacgcagtccattaacgttccaagagataagtttcacgtgagtttcagacctttcaagtaatttactcatattgtaacacggcagccactggttattttaatgacaattgaatcagtgcgccgtgattaaagccagacacggcggatagatgtgcgatagggtgacaaagcatgctggtgtctttggttggcctagtttcagcgcgtccgagcgggtatctttggctttcagtgatggcacgtttttccagctaacaatcactggcatgaattggacgctgaatgatttaaatcagtgtgccacggagcaatcagtagtagctaaaagaagattgatgataaaattggaggaatatcgatgttaaaaattggggtcattggtttaggtaacattgctcaaaaggcgtatttacccgtcatggcggcgatgcaagaccagtatgaatttcatctaacgacgcgtaatccggaaaaacgagcacaactagcgacgatgtatgggtttcaacacacccatgcgacccttgaggaattaatggcagttaaaccggcggccgtatttgtgcatactcccacggacacgcatgcagcaatcatcaagcagttgttattagctgggattcacgtttatgtcgataagccagtcgcgactgatcttcaggtggtccaaagtttgtatgatttggctgcggcgcggcacctgttattgacttgtgggtttaatcggcgttttgctccttttaatcagcaattgaaggcattgcctgacaaacggatgttagtggctgaaaaggttcgcgaagtgggtagtcaagatcctgaaacggcggttttcgacctgatgatccacatggtcgatacggggctattcttgttagatgaaccacttgaacacactagtggtcggttgacgacgacggcaactggcgcgttggcgcaaggctatttgacggtgcagacggctcatgagcaattagaagttatcacgaatatgtacggtggggtcaatctggaacaagtgacagtccaaacgacggggcaacgtgcgtctgtgactgatttaagtactaaaaccgtgatgacgacggcaacaactaccacgacggcttttccggattggacaccgacattggaaaagcgaggatttgcaccgctgatccgtgcttttctgacggcggtaacaacgcacgggcctaatccagtcgacccaactggcgcaattaccagtcacgcggtgtgccgtcatttattaagtgattaaaaagtgctaaaattaactgataggcttacaaatttcaacttgattatatcgtttcaatagcgtttcaatgctgcggtgcttgatacgtcggcctaaattaaaaacgctatgcggttaaagtgattattaacgtaagtgaattaaatcgaaacacgaaaggaacttttcaccatgaccaaagatgtcttggccacttttccagccatcgaaattaaaaaaaatgaatcactaagtcattatacgaatactaaaacaggcggtcccgccgattacgttgcgtttccaaagtcaatcagcgaaacgaaagctctgattacgtttgccaatgagcaaaatttaccactaaccgtgattggtaatgccagtaatttaattgtcaaagatggtggtatccgtggattaacgatcattctcacccgcatgaagcaaattcatgcgagtggcaccaaagttgttgctgaagcgggtgccgcaattattgcgacgactaaggttgcttgtggcgctagcttgactggtctcgaattcgcagctgggattcccggtagtgtcgggggtgcgattttcatgaatgctggtgcgtacggcggcgaaatgagtgaagttgttgaaacggtgacggttttgacgccagcgggtcagcttaaaatcctggatcatgacgaattagattttggctatcggcacagtacgatccaggactatgatgatattgtcgtatcggtgacgtttggtctcaagccaggtaatcagaccaagattcaagcgcggatggacgaattgaatacgttgcgagcagccaaacaaccgttggaatggccatcatgcgggagtgtttttaagcgaccaactgggtattttactggtaaactgattcatgatgctggcttacagggccatcgaatcggtggtgctgaagtttctaagaaacacgcgggttttattatcaatgtcgatcacgctacagcgaccgattatatggatatgattcactacgtccagaaagttgtatttgaacggtttggcgtccatcttcagacggaagtccgaatcattggtgaagacgtcgttcaaggttagttatgtcaatttaacaaagggggcaaccactagatgccgattatcgaattagtgattttactggcatgtttagtgctgctgtcgaatgtattgagccactatctagtcgcaatcccggtcagtttaattcaagtcgggctgggtctaggagtggctttattattaaatgtacaggtaaaattgcaaacggattggtttatgctcgtctttattgcgcccatgctgtacaacgatggcagagaatttccaaaacaggaattatgggaactacgcggggcaatttttgcgaatgcaatcgtcctcgtctttattaccaccatcctcggtggctttttgattcacgtattgatcccaacgattccgctcgctgttggaatcgcgttggcggccattttatcgccaactgatccgattgccgtgcagtcgatctcggaaggggtcaagttacctaaagaaattttgcacttggtcagtggcgaaagcctgattaatgatgcgagtgggttaattgggttcaaatatgcgttagcagcagcggttaccggtacgtttgtactcggtgaagctgttggggatttcttctatattagtctggtcggtttggccgttgggctggcgctgatcacgatcattcaactcattcgggacgtgttacgacgagagggtatcaacgatatcgtgttcaacgtggtgttacagattctcacgccgtttgcaatttatttcattgctgaagaatggttccacgcgtccggtgttgtcgccgttgttgcggccggggtattatcgcacttgcaaaattcacatgaaagtgaagatgcgccggaattacgattagtgacggaacgggtctggaacgtggttgtttacttattgaatgggatcgtcttcctgattcttggtattgaattgccggcagcaacgcaagcaaccattaaaggcgcgcatacaaatacgtttcatgcggtctttgacgttttaatcgtctgggggattttgttactgattcgggttgcttggacatacgcttacatgttgttcaactggttacgacatcacaagaaggccaaacctagtctcagaattgcagcattgtccggtttatcaggtgtgcggggggccattacgatggctggggtcttcacgattccaaccgtggtggcctcgggcaaagcctttccggaacgtgcgctcgtactgttcattgcggctggagtcatcattgtaagtttagttgctgctgcggctattttgccattgatggcggccaaatcactcccctttgttactcggggatccagtccggatgaagacgacgcggtcttggcagacggaacggatgacggtgatgatagcagtgggcaattaccacagttaacatacaagcaagcccgcatttatatcttacagttagcgattcaaaatattgaagaacatcggcggccagctaaccaacgtgcggcctatgatttgatcctggaccagcagtttcagattcggcgtctagaagtggcgtcgcagactgcggatgagttggcgccgatgctgacagatgaattggaacttcgcttagtggcactgaatggtgaacgggcagcagttagagaaatgattgccaataaacaaactagtaagttagctggacaggtctacttgcggcgtgtcgatcggcgcgaacaacgtttcttacaggcgacacatcgacaggggcttccgacactgcgctcattacggttgttgttgacgcgtgcaatgcaagggattcgactatggttagcacctggcgatagcgaagaattacgagtggcgttgttggatattcagcgtgaagcttctaaagctgctattaaagcgttgtcgcagtatctcaaacaggccaacgttgatgagcaacagtttgatcgccaggctctgtatcacttgatcgttcattaccggaatcgcatcgagaatgcgaaaaatgatcacacgttatcacgtgatgattatgaacaacagctgcatggactacgcatcaagagtcttggtgccgaacgtgcgggtgtacagcatttgttagagagtggacaaattagtttacgcaccgcggcaaagttacggcagttcattaattactcggagaacttattgatgctcaatgatattgaggccgatgaagattagttaactttttagattgtaaatcagtagttctaggttataatgatgttagagtagtattgacggtgaatggttaggtttgcaaattaatcattacttaagcggacgaataagggcagccttacagggggaaacatcattatgacagaatcagaaattcatgaacgcttcgtggacacttatatgcatattttaaaatatgtcggggacttcgtttcagtgccgacccggccgtataagataacgtttgaggcctacacggttatgcggatgattgcaacaagtgaggagccgctgacgttggtcaagattgcgaaagagcagcgggtttcacggagtgcgattgcacgtcaaatcaacgtgttattagatttgaagtacattgaacagaccacgaatacgcatgatcgccgaatcaagtacttatcgttaacacctgctggtcataaagtggaacaggaaatcaccacggcttccgaggaacgttttcatcaatgggtccaagtctatggtgaaaaacgggcaagcgatacgttgcgttatatcaacgatgcggaacaaaaggctaccgaactgggtttcagtggcttcagtgggttgcatgataagcgggggcggcataccgaatatagtgatcctaagacgaagaattagctaatatttagttaataataagaaacaccgtttgaaccgattatcaaatcagttcaaacggtgtttttgattacgctaggacttatccggtgtttgatgaggaactgttggcatcgtgaatcgccaagccgcgtagatgaggagttgaagtaaccacatcatcaagacaaaagcgagcatctttagcgaccacatttcaactaattgtttcacaatgtactgtggcgtaattagtaagtagatggagtgcagtcggaggaatcggccaacgtagacaccgacactagcaaataggaagagtgcggcacagatgataccacgactagcagggagtcgctggaagtgtaaacgttgggtcagttgctgggcaattcggtcaacgccccaggtaccaatgattgtagacaccatcattggcccaaccaagtaagcgaaatcccgccacatcggtaagtcgaagcgcaagagaccgttgatgccatacggcttcaataggctgaggtggaataaatcagtcattaagtacggtgcattcggatagaaaagcaaccaaatgaccgcaatcagccaaaataatagcgggctacgtcggggtgtcagccaaaaactcagctcgatcgggacataagccaaaattgaattaagtaatagaaaatggaacgcgccgtgcaagtcgactgctgcgaagatgaaaaatccccagaatgcgagtcgcacaaaccaccgctgtaacttagtcatttagtcacttcccttctggtactaattctaacagaaatattaatcaagcaatattaaataacatcaagcttaatatttattcaaaatctagctaaaaagcgcaggctctgctgaaatcgcaccgcgagaaccgggttgccgtgctataatgtgaaagtaaatgattttcatgaggaggagactaatgactttcaattggagcggtttgttgaccttacaaaactttgtccgactccttgacattcttgcggtatggtttgtcatttatgagctgattgtgttgctaaggggcactaaagccgtacaactgtttcgcgggatcgttgtcattgcgattattaaagctgtgagtgttttgattggtctggacacggtatcgtggattatggatcaaattattaactgggcagtcattgcaatggttattatattccagcccgaaattcggcgaggattggagcatttagggcgtggctccatgtttgcgcgtggtaagcgtcagaatgaagatgaagagcggatgattgccgaactggataaggccatccaatatatggctaaacggcggattggcgctttaatgtcgattaagatggacacgggtcttgaggattatatcgagactgggatcgcattagatgctgatatcaccggcgaattattaattaatatctttattccaaatacgccattacatgacggtgccgttattattcaagataatcaaatcaaggttgcggcggcgtacttgccattatctgaaagcaatctgattcctaaagagttaggaactcggcaccgtgccgcggtcggaatcagtgaggtaacggatgccctcaccatcgtcatttcggaagaaaccggtgaagtgtcgattactaaggacaatgagctgatgcgggggatgacgcgtgaaaattacttacggtatttccgccaagtcttactaacgcctgaggattcaaccaagcaaaacgcgcttcaaaattggtttggacgagttttcggaggaggtccccgaaaatgaaaaaatttatgaatagcaattggtcaatgcggctactagcactgctgtgtgcgttggtgctcttcgcctacgttaattcgttaaagacaacgcataacgccagtattttgacgaatagttcatcgaaaacgacattgacatctaaccgtaaagtgaccattagcgcgcccttagaactgaacgtgaatagtacgaaatattttgtaacgggctatcccgaaaatattaaagttacgatcgaagggccgtctgctttagtcacaactacggctaacacgcagaattttaaagtttatgctaatttatctaagttggcagttgggcggcacagtgtcaaagtcgaagtcgatggcttgaataaagaattgagttatggacttagtcaaaagtacattcatgttaatattcagccacgacgaacggctacttataaggtcagcgcagacttcaataaagccaacgtagcagatggttatgaagttggatcggcacggctcggaacatcatctgtcaaagttacgggcgccgtcagcgaagttagcaaagtcgcgaaagtcgttgcggtcgttaataccaacaagaatttagagaaatccgtgaaccagcaggctatcattgaagcattagatgccaacggtcaaaatttgaacgttgtcttgacgccttcgaccacgtcggtgtatattcccattacgcaggcgacaacgacgaaagatgtgccaatcgatttgaaagccagtggcaagaccgcggcggacaccagttattcattctcatctgacacgaagtcagtgacggttactggcacgaaggcggcattggcgaagttgaagtctttgccagtcaatgttgatgtgacgaatgttgattcaaccacgactaagacggtcgatgtttcgactagcgatgaggatgggatctcgtcagttagcccaacgtcggtcaaagtaaaaattacagttaaaaatgattaatcatgacacttttgaaatgaggtaaattataatgaaatattttggtactgatggtgttcggggaattgcaaattcaggcttaacacctgaaatggcttttcgtttaggtcgtgctggtggctacgtattgacggaacatgcggaaaacaagagtacgcaaccacgcgttttagttgcacgcgatacccggatttcgggccaaatgctggaagaagccttgattgccggcttgctttcagccggaattgaagttttacgtctcggtgtaattacgacgccaggagtggcctacttagtacggatccaagatgctgacgcgggtgtcatgatctcggcttctcacaatccagttgaagataacgggatcaagttcttcggtggcgacggcttcaagttgtctgatgccaaggaagaagaaatcgaagaattactggatcaaccgaaagacactttaccacggccagcagcagaaggtctggggacagttgctgattttccagagggtaatcttaaatattcacaattcttggaacaaacgattccagatgacttaagtggcattcatttggctgtcgatggtgccaatggttctaccagtaacttagtttcccggatttttgcggatttgaacgtggaatttgatacgatggctacggcaccagatggcttgaacatcaacaaaggggtcggctcaacgcatcccgaagcattatctaaattcgtcgttgaaaaaggcgctcaagttggtttagcctttgatggagacggtgaccgttgtatcgcagtcgatgaacttggaaacattattgacggtgacaagattatgtacatctgtggaaaattcctcagtgaacgaggcaagttgaagcaggatacggtcgtcacaacggtcatgagtaacctgggcttatacaaggccttagaagcagctggtttgcacagcaagcagacccaagttggtgaccgctacgttgtcgaagagatgttgaaggacggctataaccttggtggtgaacaatctggtcacgtggtcttcttagactttaatacgacgggtgatggcatgttgactggaattcagttattgcacgtcatgaaggaaacgggtaagaagctttctgaattagccgccgaagtgacgacttacccacaaaagttagtgaatgttaaggttcaagacaagaaagccgctttgaacaatgataagatcaaggcagttatcaaggacgttgaagatgaaatggccggtgatggtcgcgtcttggtacggccttctggaacccaagatttattgcgggtcatggcagaagcgaagaccgacgaactggttagcgcttatgtagatcggatcgtcgatgtggtcaaagctgaagttggcgttgaataattaagtgatcagaccgatcatcaaaaaagtcgttactcctagagtcgcgactttttttgttgccatgaaacgaacggttattgctaaatgcggttaactggcgactgtcaggggacccagtgcctcccaaaccaatttgaccgcaaaaaagttacaaaaaattcgaaaattcgtgatgcccttgatttatcagcgttttagattggtatacacgctaactaacacgtataccaatataatatattgttgacttttattagatgtaacggtaaagttaacttgtttctaggaaatataccaattggaggttagactagaccaattgttaattggttaaagcggaatagcgccaggactttagaatctaaagttgacgaggatgacgtttatcgataatcgacgggtgacgtcagggactgcactctacaggtcaattacaaaaaccgactgtgaggttggtgacagatatattgaccacgcagctagaaacaattcaaacagtaaaggaagattaatttatgtgtggaattgttggtgtaacgggtaaagatagtgcagtatcaatcttattgaacggattggaaaagttggaataccggggctatgattcagctggtatctatgtcaatgatcaagatggtcatgactatttagttaaggaaaagggtcggatcgatgacttacgtaaagaagtaggtgaagctgttcatggttcgaccgggattgggcatactcgctgggcgactcacggtgaaccgagtgttgccaatgcgcatcctcaagtttctgcggatggccgcttctacttagttcacaatggtgtaatcgaaaactttgaagacttaaaacagacttatttaagtgacgtgacttttaagtctcaaacagatacggaagtcattgttcaattagtcgatcggtttgtcaccaaggaaggcttgagtacgttggccgctttccgtaagacgttaggtctgctcggccattcttcatatggattcttactgatggataaggaagatcctgacaccttatacgtcgcaaagaataagagtccattattaattggggtcggcgaaggctttaacgtggtctgctcagatagtttagcgatgttagaccaaacgaaagatttcttggaattacatgatggcgaaatcgtggtcgttaaacctgatgaaattaaaatcacgaaccaggccggtgaaccagttgaacggaagccattccatgtcgacattgacgcagctcaagctgacaagggaacttatccattctacatgttaaaagaaatcgatgaacaaccgaatgtgatgcggaagctatcccaagtttatcttaatgatgcgggtgatccaatcatcaatgatgacttgttaacagctcttaaagcagccgatcgactatacattgtggctgctgggactagttatcatgctggtctggttggtgcaaagttatttgaatcgttggctaacgtgccaactgaagtgcacgtttcgtcagaatttgcatacaaccaaccattattatcagcacatccattcttcatcttcttgacccagtctggtgaaactgctgatagtcgtgaagtgttattgaatgtgaacgatcaacatttcccaagcttgaccatcacgaacgtgccaaactcaacgttatcacgcgaagcaacgtacacgttgttattgcatgccggcccagaaattgcggttgcttcaaccaaagcctataccgcacagattgccttacaagccatcttggctaaagcgttaggtgtggccgttgaccaaccagctgcaacagctttcgacgtgaaacagcagttggcgttagtcgctaatgggatgcaaagcttagttgatgaaaaggctacttttgaaaagattgctaagagtgccttattgaatacgccaaacgcattttatattggtcggggactggattacgccgtctcattagaaacggccttgaaactcaaggaaatctcttacgttcaagctgaaggtttcgcatctggtgaattaaagcacggtacgattgctttgattgaaaaggataccccagtgattgggattattacgcaaaagaataccgctgggttgacccgctccaacttacaagaagttgctgcacggggagctaagacagttactatcgtcaccgatagtttagctaaagatggtgacacggttatcttgccaacggttgatgaacgattaacggctttgcttagtgttgttcctggtcagttattggcctactacacgagcttaaacaagggcttagatgtggacaaaccacggaaccttgccaagagtgtgaccgttgaataatttaaagtaagtgtgtgggcaccaagaaacgtcaccgttcgattacggtggcgttttttgattgcccacaaagcttttgcataatttttaactactaatattcataagactattgtgaaagttgacaatcttttggtatgataaagtaagcggttgcgataacacaactaaataattagactattggggatgaatggtcatgctgaaatataaatattttgcacagccaattaataaccttggaaccaaccgaacaatcttgtatgagttattattacgacagtgggatgagaggcaacaaacttggcgaataccagcgacctttgaaatagcgccaacagaattgattcaattgctggattgcgctattcaggaattaaataaccatcatgtttccatcaatttaacggcgcgtcagtttgctaatcctgactttcaagctgcaattactcactatgtgcagacgcatttgttaccacgagaactaactgttgaactagttgcgacacctgagctaagtgagttacagcaattaagtgttgggtaccgggcagctggtatattacttgcttttgatgacgttggttctgataacctattccaacagatcaaaatgatgttgccatatgtgaatacggttaaattcgcgttacaaaatatgcgaccgctggggaccccaactacggatgcaattgtttcgacgctcaaattttggtttgataaggcggaggaacagcaaatgctatttacctttgaaggcattgaatcagcggctgatgttcaactggctaatcatctaggcattacacgagggcaaggatattattttgccaaaccgcaactacccgcgacatttatggcatgacaataatggtatgctacaatagtattcgtagcaatgtaactgagtgtcatgttgatgtttaatcggctgaatcacatgacgagacgaggccgattttgttagtaaatgataaaagatggggtggctacttgtggcaatcaatttaattgcaactgacttgaatggaacattattgcatcaagatcagcgttttgacaaagaacggtttaaacgggttttggcgcagttacgggcgataaatgtttccctagtactttcgtccggtaaccaatatgcccatcttagacagttatttaaagatgttatggcggataatattatcattgttgctgaaaatggggcgtcgatttatgcccaggaccgcttgatctttgatggtagtctttcagcagaccagcaacgaaagtttgtgactgttgatcgttaccagccactattcaaagacgcatacgtaatcttagttggtagccatgggtcgtatactgagttaggagcacctgataagttagtagcgatggcccgtcagttttatgatcatttacacttggttgcggatctggacactgttgatgataccgttaaaaaaatcagtatctcaacgtcaccggaccaggctgctgctctggtggcacgagctaatgattattttgatggcgagttacgtgcgcatgatagtgggtatggcgtcgtagatttggttgatcagcgggtcggaaaattaccagcaattcaattcttggcgactaaacttgggttaactgcagctaatgtgatggccttcggtgatggggcgaatgatgtcccattattgcgatatgcagcgtacagttatgcgatgtgcaacgcaccggcggatattcaagccgcagcaaaacacgtgacggccctggataatgaacatgatggggtattagcaaccattgaacaagagttgttaaataattaaaagcctataactagtcagtaaaaagctgagctatcgaatgaacatcgttattcgatagctcagctttttgggtcctattaaagtgattgattagggtagaagaattgatgaatgccataagtgttgagcgaaactaaacgctgctttagttcagccaaagatagtcctaaatcaccattaaaatagagccggaaaaaggttaaattgttgtggatcaaaaagcttgaacagaccttagcatcgattgcagataaatgatagtttgtttgaatcgtcgttgtaagccctgctaccacggcagcgtggattttccgagacaaaaaactataatcatcattcaacaaaatgactcggtgaaaagcttcagattggcgaaaataggtcactaagcgatcaaagattaagccgggttggctaatgtttttcttgaaatcttgcgggtcaatgagtgctagaatcttatcagcaccttcttgaacgaacgtttccgctaaatcgtcaatggaatcgaaatgtaaatagaaagttttgcggttgatattagcgacacttgtgagctccttaacagtaatatcacgatagcgcggatactttaaagcaagcgtccgaaaagcctctttcagcgcagtctgggtgcgctgaacacgtaagtcagtagctggcataatctgatcctccttattaattacatttgatggggtggtcattattaaaccgccgctaaatgtactagtcgttaagccacatgtgggtattattatcataatagcacttattttgatagttaactcgtcctgagtcatgacagattaactcgcgcaacgtgcataatagcatatgcgcctagtaggtaaatggtaatgaggccatgtccgtcgactaaaatgggttaggagattttcgttcagtcaatggtatggtgtaacgcattattagtgagtcaaaaaagctcccagtagtttgcattctgggaggtcgatttgaatcattcttgagtagttagacatcgtaaatattagaaaaacgataggccgtttggtaggttacaggaatattaggttcgataatgatactgccaaattccttgtggtgaatagcatccggtaatttttgtgcttgcagggaaagaccaagttgagaacgcatcggtttaccgccattgagtcgataacgatcatcacggtaattagttgcactggaaaccacgactgccggagcgttcgttcgcatcgtgactttgcgtccactgatgcgatctagtaattctacttgtggatatggggtgtcgtttaagacgaagccgtgatggagcccgcccttgatgttagcaacctggggcccaacctcgactgggtcacgaaaatcaaatggggtgtcggtgacccatggcaacttaccagttggaataccgtgtttgtttaacgcggcgtactcgtctgcattgattttaagaacatggtggtcaatgaggcgttccgcatccccacttagattgaagtaggtatggttgctggggttgaataaggttgttttatcacttttaccagtgtagctaatagtaaatttaccgtcgttatctaatacgaaattagccgtgatcgtcattgtcccgggatagccgttctcaccgtccaaggtaatatattgcatgacgagtccaacttgatcactagtgtgcagtttacgttctaaaaaccatggttcaaatgaaatttgaggcatattaccaccgtttagatgattttcgcccgcattttgagttaagtcatactgccgccaccgggcatttttgatgatccccgcaacccgagcgatggttgcaccgaaaaaagattgataggtgatgtagtcggcgccgtcgtcaaatcccaagacaatatttgcaaaattaccatctttatcatgggttttgatcgcggtgactgtggtgccccagtccataatagtgacgctcatatgatgattgttcactaatgtataataattaatcccgttcccctgatgctcgattattttcataatgccctcactcccatagctgcctgacatgttaccgcctacttttagtatatttcattcttaaagggaatgcgaataataacccagcaagtgttaatgcgagagtgacagggttagttgctagtgaggtcaatttaaataactagtgtaaataattataattgattgttgataataattaaaattatctaggttgagaagtttattttaaatcttggtaattgtgaatggtaccaatctattaaataaggtgaattaattaactttgtgcaagtaaagacggcaatttagtggcgaacatggctggctgagggtgttagaaaaagattaatgagtaaatagaaataatttatctatttattttggctaactgttgacaacgcttacaatatcgcttattcttagtttgtaaggtatttaattaccttctaatcaattctctttctctcttatgccgaccactatctgcttggatagtggttttttgagtgaaattagcgaatttatggcggactagatgaagataaggctctcttgtaatttttgaagattgatgtttactcagaaaaaggagtgctcggctgatggtagcattttggggctgactgagttagtttagtgttcatcaagtacaggtgattaggcataccaagcctgatcacctggcaattactggtcagttttgacacgactgccaaccccgcttatactaaaatgtgaagtgagggattgcagttgaaaaaccatgaagtattagacttaattcaagaaataacacgtaatgatgggacctcatacatggagatcggaaacatgttgatgaatggccgcgctgagttagcagctgaacgtggttttattaagcaagtgcggatattacaactaaacattccgcattccacgcatgttgccaagtatgagcaatatattaatgaaacatttacgattcccgatgaaacgatggatcattgggaagaatggacaaaaacacctgacatgcaagctgaggtcgatctgattttgaaagaaaatcatattggctaaaagctgttagccaaagtctagcgcaggagtgtgagtttatcaaacggcggttgttttttaggaggcgttggctcaaaagttgaactttcagaatgtcaattctctaagctcagcttttttgtttggatcatgtaattgactgattgtggtgatttaattgcgggtgcgtggtgggggaaaataacttacaaacgctagtatcagtgttattatcaataagcatgtttaaggaggctcgttattaaatgaagaatggggcattgctacaatttattcaaagtcatttcaaagtcatttccagacccgttttcgttttcgtaacgcgtttgagacccaattgactgttcagattttaagtcgattaattggcgaacatccggaaagtttgttattgactcggcgagatgttgaagcgttggcaggctgctcattggacgcgccggcactacagcgagaatattttccgcagcgtgcgatgacactgttagaaacggcgttagatgagctggttacgttaagtgttatcatacaccaggatcagggcaggacccgttatcccttatttcggagcgtacagcttgatcaagtgtgtcaacgaattgtgtttaacttgaacctggacgtgttgccacaattaacggactggtcacgggaattacaacaagaacaggagcgattttaagtgacaaagagtgtgattgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgacgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactgcacttgccggacttgacgttacccgtctttgggttgcagttagggcacccaacggatgttcctgaaaagaaacctcgattagggttgcccgctgtgttgtttcaagatacctatgctgagcctgcgagttatcaggcggagttggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataatcgttaccataacactaataattagaatggctgagcgaaaaataaccgttaatgtaacgctcccatgtcgctattagctgacatgggagattttttggtacctgggaggacgaatcttaacattaaaataaggttaaatattgttatttttactaattataatataattaattctgagacgatgtttactaagcaggcccgggctgcgttgcagattcgagtgaaagctgagtcgatccttattctgatgtgtgatagtaacattgttgcaaggcttgaaaggggcggataatgtgatcaatgccaacttcagaaaactcgtcttagggcgagcagtgggtaacgctggtgacagcatctacatgattgccatgaactggttcattctccaattgaccaacagtgcgttgtggatcggcatcatgaatgtggctattgttttaccgggcgtgttgttgtttctgtttggtgacagtatcgaccgacattctaaacgccgattattagtcgcggttgaattttcacagttagtgatcgtggtcatgctaattggattagttgcgttacatattaagttgccaggtatctatgtcgggctggtattcgtcgcggccctttttggatcactagcttatccgattcaagatacattagtaccgctgctcgttgagccagaccagctagttcaagcacaagcggacatgtcaattgcctacaagggaacggattacgtgttcaacgcgctgtctggatttttgatcagcctctgctcagtgctcggtgttttaatcatggatgcagccacgtttgtcgttaccgttgccacttttaggcggatcaaactcgctgaaccccgtcagcaacacacgcgggaaaagtccttgtatctcaaccagattttggttggtttcaaaattatcagcactgatccgctgctgcgtttattgacgtttgcgagcgtcgtcatgaatttcttctttggcggtttgaatacgtacgtcgttttatttgggcggcatttcggtggctcgatctactacggtattttggagtcgatgtcagccgttggaatattattagggatgacggtagtctaccgacagttaaaaaagttgaccgttcggcagtcttacctcatcggcaactttgggcgcgcgttattcatgatcttgacagtagtgtcgtacaaccagttctggctgtttgccatcatttacttactgagctttgtctttcaaggactgacgcaagtatttgagacaccgatgattcaagcgacggtcggttcagaccaactcgggaaggtaatgacctgcttttatacgctggtttccgtgaccttaccgctgggttcgctagcgttttctttcctagctgaccgctttgatttacggctattcttattactatttgccctcttttatgccggcatattcctgctatttctagccagtcacgccttcaaaaaagtagacgaactacaattatcataaaccccacgcgatattcattaatctgtcatcaatcatgattaaaacgtgccgattaggtggatttctgttcgtcagcaatgatcgtcctattccgacctccggggctgggtgacaattgctggaacgtaagccgacatcgatttgagctaacgcccaacccgcgtcatctcaaatacgagtcttattctaagccggaaggaaatcatttccgactaagaataatttggctactgagcattgtcacccagcccctccagtctcaagagtgtgcggggccacgagttgaagccgagcattgcctagccaacggattaatgcggttttggcattagtccgttggcgtagcaagcacaggctttagtggcaccgaacacgtttcgggaagccgctcgaatggctgatgaacgaccacttaactcggcacaattggtcattgactattttgatacaggaactttaaacgagacgttagggttaccctaaccactttgttgaaacgttcgattactactatggtgattccaaaatagtaagctatcacaatgtcattttctacctgacagttgctcgacaaaattactgtttatgaagaacaatgatgagtccaataaaagttgggtacatctccgtctgccattcgaacactgtcccgactggaaggcgtttctgacaatgcccagtggtgaaatttcacttagcaagcgtcttgtgcttggttagtgaaaggccagtatttaagacgtgggctttggcttaaatctgtgcccaccacgttccggcaattggcagaaatgcctggaagtcggcataggacacactaactaagcaagtttacgctaacctgaactttttccagcgggtctaagctggttgcttttgaacttaaaaacttggcacgttttaatcatgaaaagcaacaaacacagtgcggattatcggatagatgagaatggcagtgatggactcaaggaaaatagtgctgaactaaaaacgtcgtgactgacttcagtcgcgacgtttttgattagaaatttagtttagttggtacttgattgggcgtcgattgggatgtgcttgaatagttgggctgctttgacggcggcttgccagccttggtaaaggttcgcacgttggggcgcggccattcggggttggaagacattgccggtttggtggattgatttgagttcgtccaaatcttgccagtatcccacggctaggccggctaagaatgcagcaccgagtgcggtcgtttcgaggtcagcggcccggatgatcttgacgtttgagatgtcggcttgaaattgcatcagccagttgttgcgggctgcaccgccgtcgaccatgagtgtgggcatggtgatgttggcgtcgtttttcatcgtatcaatgacgtcgcgggactggtaggccagtgactgtagcgtggctttaacaaaatcagcccgggtggtcccgcgggttaagccaaagacggctccacgggtctcggaatcccagtaaggtgcgcccaatccggtaaaggcgggaactacgtaaacttcgttgtgattatgggactgttgagcaagactttcggattctggtgctgattcgatcagttgcatgccatcgcgtaaccattgcagggccgaacccgctacgaagatggagccttcaagcgcgtaattgatgttgccatcaagcccgtaagcgatggtcgttaaaaggttgtggtcggataattgcggttgctcgcccagattcatgacggtaaaggcaccggttccataagtatttttgaccatgccaggttcaaaggccatctgaccaaatagtgcggcttgttggtcgccggccatcccgctgattggaatttggctaccataaagcaagtagtccttagtcgtgccatagatctcagagttggaccgtacttctgggagcatcgcagcaggaatgttcagtaggttcagaatcgtttggtcccattgtaagtcgtgaatgttgaataacatggtgcgactggcgttggtgtagtcggtgacgtgggtctcgccaccagtcaatttccagacgagccaagtatcaatagtcccgaaaagaagttcgccgcgttccgcgcgcttttgggcaccatcaacgtggtctaagatccagcgaattttcgttgctgagaagtaggcgtcggtcactaggccggtgtgccggtgaatcagatcgcccataccatcagcgatgagttgctcagctaacggtgcagtttgccgggactgccaaacaatggcgttataaatgggtagaccggtttgcttgtcccagacaacggtagtctcacgttgattggtgatcccgatggcttcgatttgattaggtttaatattagcgtcaattaagacgttagcgatcgttgaggaaaccgcgttccagatttcagtagcgtcgtgttcgacccaccccggttgcggaaagtattgtggaaactccttttgggcgtcggcaactttttgaccggcgtgattaaaaataatggtgcgggtactcgtggtcccctcgtcaatggccatgatatatttggctgacataacttgttcctccgaagattgtaatcaataacatcatctttgatgctagcatggatagttggacttgtgaataaatataaaaaacttaatatataaactggcatcccatgaagtatcgagaattaatcatcgtacccataccaatttgctgaaatgaggaaagggttaccatgcttgttttgataatattacttttgtacaacggttagtaacggcgttgaactaagattaatgaatatttgaaatgtagaccaatcggcatataatggggactcaaatcggtgtgaaatggaggattcctagtatgcaaaaacgacgcttttttcttaaaggctctgctgccgaggttgcttggctcaatcggcaggcggcgtggggctatcaattgacggcgattcacggtctgagttatcagtttaaagaagtcccacaagcacgccagctgattgccgaatacatgccacagacgacgttacaagctatgacgacggtcttccaaccacttactagttatacgtttcatgatgatatggcggtggtttattcaactgtggcccctaaacaacgagtggtcaacaatgatcaacaataccgcttagcagtgtatcgacatgctcgcgatgtcgccttgaactggctcaatggctgggtattggtagtctggctcatgatgagtgcgacgattgtgattagctcgcaattgcaagcaacgccactattaacccggttgttattacttgggttggcacttggtgcgggggtgatgatggcaggtattatcgttggtgttcggacagcgattcgttgtcaccgggaagtgtgtcgcttgatccgtatcacaggagacgatcacgagacgtggaagccgacttttcacgtgttgtttaagcatcaacacgccgctcccgatacgacttgctgggatgatttaggtagctggcaattggcactgcataatcagcgtggggattactactttgagttaaaaacgacattgagtgaattagaaatcactaatacactggcacaacgcttttcaaaacaggacttttccgtggtatcgtggttaggtttgtacgttgtttgaggtggatatcatattaattatgtgaatttagtgtgactttttttaaaaaggacttgttttttatcataaaagcgtgtataaatacagacataatcattgcccggtagttcagcggtagaataattgactgttaatcaagaggtcgctggttcgatcccagcccgggcagttggtcatgtttagttaagtagcggtatctcgtgaggtaccgcttttgtcggcacaagtacagaatagcgctggcatttgatgggtaattggctggcagaactttagaaataattaactaaaaaagttctgacaaaccttgactattcttgactaaaaccgtatacttactatattaaagtaagtggtgtaaagtcacttgctgaaacttaggaggaattcatcgtgacagtaaacttatattattcaacgtccagcaagtctagtcgtagtgcacgagcatggttagttgagaataacattccatttaatgaacgcgacattattgctaatcctctggatcgcgatgaattgaaacaaatcctccggctcactgaaaatggcttcgaggacatcgtttcaacgcgttctaaggctttcaaagcattacacattgatttgtcggacttaggttttaatcagttattggacctattagttgaaaaaccacaattactcaagcggccaatcatttatgatggtcggcggttacaaatcggttataacgaagaggacattcgggcatttttgccacgttcggtacgtaagtctgaattacgtgaaattcaacaaaaactttatgacgatgatcaacaagcagttggttaatcggatttagcgtttgagacgaaagcggcccatcaagaattgtgttgatattcttgatgggccgctttttttgtcgaaagaacaatatcagccagccaccagggtgcgtttggttgcgtgtcttcttaacagcgtatcgcagtgtagggcgttattttacttgccgattaccgcccgttacctttgctgagtaagcagatttcttggtataatcagttggtttgtgtacaatgtaaaaaggcttaaaggaaacggagattttaacataatgagtgaacaagaccaggctgcctgggcgatccaggcactcgccgctttgaagacggctgataatcaagttgttgtggagagtatcattaaggtcatcgatgaccaacaggctgagattgagagtctacggggttcaatggaaggccaattatggagtccaactagctggcatcaagatcagcaagcgcaacgtgccgcgcatgaggacaagtccacaactaaccattaaaattgagaagacgccacaaaagacggttgttagactattattggtctaacaaccgtctttttgtcactgcgtttgtgaatttaagttgagcgccatgccgtgatttacggcgcagtcgagcattaagcagccagcaagggggtgcaagcttcaggatacagttgtgatcagtaatccgtgacgcttgtcttgcggtgctgggccacaaattggaaggtagctgccacgagtccgccaatcaggatacccgttgcgttggcaatgacgtcgttgatatcgctactgcgattgatcagccaatgttgtgacatgaaatattgcagactttcaatgctggcacccactaacaagcccgttaatccgaggcccaatagtgggtagtgatgaaagtggcgtttaattccccagcctaagggaatcgtcagaatgatattttcgataaagcccagcccgtgaagatacaaccgtgataggttcacttggccgacaccagctggcatcacgtagatggcagttccgtcgaatgacagcggggtaaacaaaatcacactaagaacgtgtttagaatcttttcaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgacgaacgatgtataaactgaacgcttctgagccaaccgatgttggctgacaatttttttaaaaccttatccagaggagtgataccagcaggagatggcgttttagtccaaagtaaccaataataatagacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaacccctgtttttgatctaatttaactaaaatcaaatcgaatgtcaaagtatccaaacacgttctaaggccaaataagtaacctaagccgagtagctgccgcgtccgggcttgtggctggcgaacgtggacaagaatcaccaaacaacttagtgttgcaactattaaaataattctgaacggttcccaacgcatgcacaccactcctcggtttggattaactgtatcttaccgtaaactcagtggtcagaagtaaagaagacgtgaagcttaatgaagcctttaacggcttaaccaaatcccaagtaaatcagtggttagatgaccgtgattgatgttggtcgtcagccatattcgcaattggtttcgtagtcagcgctaaagcagctacaatcataatgataattagactgaaccagagtgcgatctgggtgccgagggtggtttgcatcgtactcgaagcactcggtgccatgcgggtgcccaatgtaatcaagacggccataatggcggtaccgagcgaaccagaatactgttgtagggtgttgaaaagcgcgttgccatcgtccattagttggggcggcaattgttgtaaaccatacgtcagggcattgttaaataagcaactgaacccaatttgaaagccaacaaataagccaatgatcaagccgaccgagagatgctgggctaaccctgcgagacttagtgttgccaacagtaaaaagccactaccaatttggaatggtcgccgaatgccgcgacggtccatcaatttaccagccaaaggtgatagtattgctgaacataagcttcctgctaatagcattaagcccgacactaacgcatttttacccaaagcaagttgtgcaaaattagggagcagaaaggtcagtccaatctgaatgaattgaatgaagaagtaaatgagaagcgcccgggtaaagttaccctgttggaagacggccaggttgattagtgggtgcgtggttcgggttgccgaacgggtaaaagtcagtacggcgagtaccgctaataacagtggtaaccagacgaatactaagcttaagccatgtgtactaaggttattgacgctaaaaatcagcaggatgagtgccgcgacgactagcccgaattggcataaggggaacggacgtgaccgtggtgcctgcgtttggcgaatagttttggccgttatcagccaagcaatcagaccaaacggtagggtaatgccgaaaattaagcgccaggataatagttgtgtcactaagccgccatatgttggtccgagtgaaggggccaatgcgatcaacattccagcggtccccgtaaaacgaccctgagcagtgaaagggacctgggtcatgatttgcgcaaatactaatggtaatgccaatccagttccgatggcttgaatgattcgaccgaatagtagtaaccagagctgtggcgcgactgtacataataaaccgccaagaacgaaaccagccccgccaacgttaataattgtccgccaacggaagcgttgttgaataaacgccgtaataaccatggtagcggctacggcgagtaaataggcagtggtgacccattgaaccgttgctagagtggtgtggaattggtgcatcaaggtcggaaaggtaacgttcattgatgtttcaactaaaataccgcaaaaagccagactggcggtgccaaaaattgcaaccttcgtttgggttgggatgacaggtgttgttgtagacaaaataaaacctccattgatcaaggccagctcgtttcgtatgtgaaacgacgcttttcttgaccaacggagattccgttgtaaagatatacaagcatcaaagacgaccttgatgaatttattaatgatttaatcctagcatactactgataaaaatgtcagtccgatttttttattcgctgactttagcgctttgttcagctaaagcagtcaggtgctcgaataggatgccttcacgcagtccattttgagagaaaatcatccggtcagaatctaaaaagcgcatcagactaatggcaggaatcatcccaccaacaataatatcagcccggtcctttgctaatccaggaatagccgcgcgaccagctgcatcctggctaatgacagtattgaatgtgtcatagatggcgttgtcacgtagccgataaccgtgaatatcttcaaagttgaggatattgcatttgcgccggttaattttggctaacgttcggttgctaccacccaaacagacgagtggtaagttgagaccgtttcgcaaccaccagacgctattaaaaattttatcaacgaaagtcatcgttttaaacaattgactagcggtaacttggtcgttgaggccgaacttttcggataaactgaccgcgccgattggcagactgattaggtccttggcctggccgtttacgataaggacgagttcgcagctaccgccaccagtatcgaccatgacgcagttagtcgttggaagcgtattgactacccctaagtaatcgtaataggcctcggttgttccaggaatcacttcgatatctaggccaacatcatttttaacgcgtttgagaaatttcttttggttgctggcctttcgcgttgcggcggtcgccacggccttgatagttaagttaggtaagtctttgtagacggcagcaaacgactttagcgctgcaatcgtgcggtcaatggcctcggcttgaagggtcggcgtatccgtggcgttttcattctcggataaacgcaccatttccttgagtcggtgagtgaccgcataactaccgtcttcttgaatctgtgtaattgtcattcgacatgaattggaacctaagtcaatgaccgcaaagttttccatcgctaatcatcctctctatcaagatctgaagcatccggctcattcttgggactcatcatcggaatgaactggtgcgcgttgctagtgggcgtagtatcgccgtgatcagccttgactgcttgctcggcttcgcgaatgaattcggcctgggagtccaaaacctctaagccgcgcccatccacacgggcgtacgtattatctggttgcaaaatgcgcgttttgaccgtgtcagcccacatcgtttcaaaaattgtcatcgcacggtgactgatttcaggttggagcagtgggaacaataattcgacccggcgatttaggttacgggtcatcatatccgcactggataagtaaatttgtggttcaccgtcgttgctaaagtagtatatacgactgtgctccagaaggcgaccaatgatcgagtggacctcgatgttatccgagatgcccttgatgcctgttcgtaaacaacaaattccccgaatgatcagttggatcttaacaccggcgtgagaagcttcgtagagtttgctaataatctgcggatcggataacgagttcatcttcattttgacaactgcgggctgaccagctttggcaatggcaatctcatcgtctagcttttcgttgataaagtcgcggatgccatctggtgagatgtgcaatttgtggaaatacggtggttcagaatagccagataacatgttaaagatgttggaagcatcgattcccatgtctgtatcagcggtgaagagccccatgtccgtgtagaaatgggcggtgacatcgttataattcccagttcccatgtgcatgtagcgcttgataccttcgttttctcgccgaacaacgagggcaagcttacagtgtgtcttaagcccgatcagaccgtagatcacgtgacaacccatttcttcaagctttttcgcccagtgaacgttattttcttcatcaaaacgggccttaacttcaacgagaacggttacttgtttgccgttttgggcagcctgcccgagatacttgataatcggtgaatcagctgatacgcgatacagcgtcatcttaatggctaacacgtcctcatcttctgcagcttcatggataaagtccacaacgggtttgaaatcatcgtacggatattgcattaaaatgtcgtgatccttgataagatcaaagatggatcgttcgcggtacttcgcgggatagtaggcgtggtattttggataattcaagtcttcgtggccctgcacagctttcaccagcttggataagaaggtcaagttgaggggaccgttgatgacgtataacgcactttcgttaatcccaagggctttagcgagtcgcgtgcgttgatgcttgctcatactcttttcgacttctaagcgcatgaccttaccgcgttcacgcatctttaattgtttttgaacttcctttaataagtccgaggtatcctcttcggcgacatctaagtccaaatcccgcatgacgcggtaacagctcgtttccttgaccgtgtagttgataaatagtgagccgacaaaggctttgataatttcctcaatcagaataaactggttcggtgcgcctggcaaaacgaccacgcgaggaaagacgtccggcacttgaacggtggcaaacttgcggtccttcttatccccatttttataaatccgtaaggcgatgttgagtgtattattcccaatgaacgggaatgggcgtgaagagtcgtctgccatcggtgttaaagccgggtacagctcatcatcaaagtagttcttaacaaaggcgtgttgttcctcgtttagatcagccatcgacaagagatgaatcgcgtgctgttccagcaatggcaaaagcgagcggtttaatgtattgtattgacgcttgaccatctcgtgggctttatcactgattgcactgacttgatcagcagcggtcagtcccgcgggatccggtttagtgtaattgactgacatcaatttacgtaatgatgcgacccggaccgtgaagaattcgtcaagattactctgtgtgatcccgagaaaacggacacgttctagcaaggggttatccttatcacgtgcttcatcaaggacacgatagttaaaatcaagccagctgagttcacggtttgtataataactttctttataataattcatttaacgtaccccccgtagtttaatcactggtgttaaaccaaagacttctttaaagaattccgctttttgtgcgaatacccaattttctaagaagaggtcatcatgagcaaagcaagtaatgatgacccgtggattgcgaattgaaacggaaattttatcaattttttgtttgcgaccgtcatccaaagcgtccgcaattctcaagatggcggatagtttggagactaataagcgttgttcgacttgtaagtgtccaaaatggcgaatgtcttttgatggtgtttgcacgctatggtagcgtgaaatcagggcgaccattcgtttttcggtatcggttaatcccatgagttcagtggcctgcaagatatagtccgaatgtaagtaatgttggtgcgggtcaatgtagctcccaacgtcgtgcacgatggcggcgacttgtaagagtaagcgctcgcgtttgcctaagtggtgtagcggtttaagctggtcgaataggtgcagtgagaatttggtgaccaagtcgcgatgcttaggttcaacgttgtacctgtccgcaatgttcttagctgctgttacgatttgatcattaaagttatatttcttatagcccaacttaatggcttcttgaataattaacccatccagcacggtcacgttgccaagccagattttctcagcattagtgagttgtagtaactcgttaataagtagtaattcgggcacgattaggcgcacgtcttcttcatcaacttcgtatttatccattaaatactggtcagaagcgttcaacacgtcctcatataaagcttgaaaatctgctttgctgagttcctccacgccagcttttgattgttgttggcgaaagagggtggcaaacggcgcgacgccgagcatgacgacgttactaggctgatctcttcgcccaggcaagaagcgaccaaagtcaacgatttgactcgaaatataatcatccaaaacttcgacatagttaggcacgctcgattgcaaatcttcaagaacttccgcgattcgaactggtcctaaacggaggctacgggagaagacaaagttactctgatcgtagtgcgaaataccgacactaccagagttgattcctaataagtaggtcggcttcgtgatcatttgcttgaatcgtggaaagtgtaccgcaactgcgactgaacgcaggtaggtttcctgactactagataaccagtcgatcttgagcccagtccggacaagtaattggtcttgaatatagtcggcattgttagcggatgacaaggaccacgacccccataaatggtagtccttaacgccgtaatcattcatgatctgaacaaaaccactcagtgcctgcgcggcttgttccactgaatcataatcgatcgtatgctgatcataaatatcctcaccaagtgaaacgtcggaacgaactcgttctacttggcgtaatgtgcgtaaattgacaatcgacaattcaatactctgaacgttaatcatcataattccaaataattttgctgccatggcgatcccccatttttatgatttcctgacccccaataaggttaaagtcatgtatttaatttaagtttaacacaggttggggttagttaaattagtattttagtagtgaaacagttagcgattacttttagtttttatacgaaagttaagcgtaattaaggccatcattaactttgtatgaatcttactagttaggtggttgatgtggtgattaccccggtttcagcggtagcgaacgctaacctaacttggcacgtttgatccaagataccaaaaaggcgtggttcagccgtaacgagtatgcctgaaccacgctagttgatattataagatttcgtgattatcgataattagtttgttcagatgtttttcaactcgtttatcagctggtggcagctgcatgtaatcaccatacatccgggtcaaaatggtgtcatacgcactgggaatcttcacttggatatcttcgaatggaacggtcgttagctcggtcaattcctgataggtcataatttccttttcgtaatcgtattgagacgccagatttttgtaagttcgggagtctgactgctcgtacaggcgcatgtattcctcacgttccagcttatagcgattgacttcagctaattgctgaggtgtgtgtttcgtaatcaagttacgcagtggtgttttgacaaagcggtaattcaatttgagcaggatcgcagcgtctgctaatttgtaatgtaacatctgtgaacgacgtaaggcttcgtcatctggaatcttatcaaacggaaagatgtcaacgaacacgcctttaaacgcattattgacgttgttgcgttcttcaatgtaagtatttacgtctaatagcttcatataactgagtgcatagtccggatctgaggcaccggtttgtaggaaaaatttgtttggatcaagatggtggttggcgacggcgataaagcgctggtagtcatgacggcgcattccaatgtcgatgtcatcgtcccacggaataaatccgtgatgacgaatagcaccgagtaaagaaccaccgatcaaaaagtaatcgatattttcagcctcacagattgcgatgacggtacgcatcaagcgcaattcaacttggtgtaagggtgtcaggggcatggtctcgtctcctttttacgtaagcgtttcaactactttcatcatacactttgttgcacaaaattgttagggaggatgcttaacgttggaatttacgggtaatttcatgcaaaacagttaaaggcgtgttatatttggtcaaaagttaatgaagtgatggtgatcgcgatgaacagtgacgaattaagcaaacttctcaatgattattttgaagcatatcaaaatacaaccaaaattatgatggacttagtggcttggcctttaagtcaaaataaactgtcatttgaacaatttttaatattgcggcgcattgccacgactgatgaagtgacactcaatgatattgcaattcagcgacaagtaacgcgaagcgcgatttcacggcaagtcaaatcattgttaatgcaacactatgtttttcaggtgccagatccgcgtgatcggcggcggctctacttacatttaacagaacggggacaacaagtcgaacggattgtcgaccaagccattacccagcactttgatcactgggtcaaccagttgggcgtaccacagattgatcaagtgctcaagatgatggggacctttagccagcaggtcacggacctcggtgagccacagtcacaccccgttctacactaggatgtacatgggactaaccactaaattagtattgatgagcaactattttggtcgctagtcaaaaacagacttcttaggaattgtcacaattcttaagaagtctgttttgttacgaatacccattgaataaaaacacttgtactaaagtagggtcgtttcatagaaagtaagcactcaaatgggcgtacttgcttcactgtgatacgtgtagcgctcaatgcttgaagaagttatggtaaaccccttcgcaagcttcaagaaacatcccaatagccattaagtacatggctaacatgttctgcattgtgaagaccaagtagagtaggacggcgtagaggattaaaaagaagattgccgtaattttggaaccagccatttaaatcacacctttgtatggagaatcgtgacgcgttatttgcctgagggtcgtgaggaccaagagcggttttaaggcaatgaacacgctttatcaatttcattctaccgcaggctcattaaaattgaaaatcgcaattaaacagattcaaaattatttagcgttcggttattgcttttaaataaacaaaatgatacgattaaatacgttaaaagaacgctaaaacacgaacgtttacaattgtgcaattataatttaggcgaatatttggagggaatcatgaataaaattgcggcatattttaatttttcagaattgaaaacgtcaatgcgaaccgaagtgctggctggcttgaccacgtttgtttcgatggcatacatcctatttgttaatccgagcgtcctcggggcttcggggatggataagggcgccgtcttcaccgcgacggccttagcgtcagcgttaggctgtttattgatggggttagttgctaagtacccgatagcaattgcaccaggattaggcgttaacgcgttctttacttattccgtagttatcggaatgggcattaaatggcaaactgctctggctggggtgttcgttgcagccgtgatttttatcttgattacgatttttaagctccgggaaatgattattgatgcgattccgcgggatatgaagttagcaatttcggcggggatcgggttcttcattgcttttattggtcttcatggtggtggcttaattgttgccaacaaatcaacggttgttggtctgggatcattgacagttggaacgacctggttaactatttttggattgatcgtcacgttgattttgatgagtcgcaaagttcccggtgggatttttatcgggatggttttaacctccattttagggctagcaactggcttgattaagatgccatccacaattgtttcggcagcaccttcgttgaaaccaacgtttggtgtggcgcttggtcatattggtgatattaattcgttacaattgattattgttgttttgacgttcttattagtgacattcttcgatacggccggaacgctagttggattggcagaacaggctggattcatgaaaaataataaaatgccgcgggttggtaaagcgttgatggccgattcaacttcgatgttagttgggtcagtgttgggaacctcaccaacctcagcttatgttgaatcttcggccggaattgcggtcggtggtcgctctgggatgagtgcggttgttactggtgcgctattcattcttggattatttttctcaccgttattaaacgtcgtgacggatcaagttactgcacctgcactgattattgtgggtgtgttgatggcagaatctttaaaacagatcagttgggaacggtttgaaattgccgtacccgcatttctaactgttatcgggatgccgttgacttatagtatttctgatgggattgctttaggcttcattgcatacgtcattacgatggtcgcaactaagcatgccaaggaagttcatccattaatgtacgtgctgttcttcatcttcattatcttcttgtggatattaaatgtctgacagttaaaggtggtcagctcgacgttattggctagttacagataatttaaatgacttaattctaaacggactactgacgcacatgacgttggtagtcttttttttgacgcgaaataggctaaaacttgatgagcttcaagttggtttgctttggaggtgactatactagagtcattcaagtgatagaagggggaggtgaagcaatcagaaagttaggataaacattgaaatgtaagcgccgtcatcaaaaactatcttgaaactagctcatgagcagtcaatcggccgagatttgctaagcggggcaagcgtaacgagtggggatgtacccgtaccaattcgatttaataagacaaatacacaattagtacggtggttaaggtggtataccggtgtcgaaaataatacaaaatataaaaatacaaaaaaatacgtttttttttaaaattaaaaacgctccaaagcctgtcgttaacgcttgtaaaccatagaaagtttcgcgaaattttcaatgatagataaaatccattaataaaagcgtttacattttgaaaattcgtgattacaataaagtcgtaaagttgataattaaaatatatcagaggaggacattactaatggctaaaattagtggttcagatgccgtattaaaagtaattcagaagtggggcgtaaaacatatttatggtttgcccggtgggtcgttcgattcaacgatgaacgccatctataatcaacgggaaacgttgaagtacatccaagtacgtcacgaagaagctggtgcgattgccgcttccgctgattataagctaactggaaagatcggcgtctgctttggttccgctggccctggtgctgtccacttactgaacggattgtacgatgctaaggaagatggtattccaatgttagcaatcgttgcacaagttcctactaagcggatgaacatggacttcttccaagcaatgaatgaagaaccgatttttgacgatgtggctgtttggaatcggactgcgatgactgctgagagtttaccgatgatgactgatgaagccattcgtcaagcgtatgcccacaatggtgtagctgtcttaacgatccctaaggactttggttgggctgaaattgaagacaactttgaaacgaacgctagcgtgcacactgttaactatcctgcaccaaccgctgaatcagttgctgatgcggttaaattaatcaaagctgctaagtcaccaatgatttactttggcgttggcgctaaggacgcggctgaagaattaaaagctgcttctgaaaagtttaagatgccacttgtctcttcagtattagcgaaggggatcattgaagacgactatcccgcttacttaggttccacgggacgggtcgcacctaagccgggtgccgagattggctttagtacggatctaatcctctgggttggtaacaatgttccattcagtatcttcttatttaataagaaggctaaggtcattcaaatcgatattgatagtgaaaaatttggtaagcgccaccatacgaacgttgctattcaggcggatgcgaaaaaagctttagcggcgatcaatgcagctggtgaagcgcgcgatgattcagccttttatgacgctgcggttgctgataaaaagaactgggacaaatggcaagccagcttcaacgatagcactgaatcaccagttcgccccgaaccaatctttgatgtcttgaaccaagaagctagtgacaaagctgtttgggctatcgatgtcggcaatgttaatattaactttgaacgcttgatccgaatgcacgatgaccagaaatgggcaacttctgggatttatgcaacaatgggctttggggttcctgctgcactggctgctaaagtcaactacccagatcgggacgtctacagtttgagcggtgacggcgctttcgcaatgctgtcagaagaaatcttggcacaagttaagtataacttgcacattatcaacattgtcttcagtaatgagaccttaggctttattgaagctgaacagactgatgatagccatcaaccactctctggtgtcgatttgccagatactgattgggccaaggttggcgaaggctatggtgccgttggttataccgttcggaccaaggctgaattcaagaaagcccttgaagacgctaagaagacggataagccagttgtcattgatgtgaagttaacgcatgcaatgccatttacaacggaacatatgtatctcgatgacgcatggcaagataaagacaagattgctgaatttgtcaagaagtatgatgctcaagcgttgaagccgttcagctacttcttaaaacaagctcaaacaaactaatttggatagataattaacgaaagaggacgcgattatcgcggctcttttggtacatagtattaagtgtcgcttgccattgtggcggtgacaacataccaagctgtagagaacactacgtgaacgttcgggaggtcgcacagatgcaagtaatcaatttagatgcccatcgattaaagatgctggcaccacaaccgccactggtattagctttaggtttctttgatggtgtgcatcagggccaccaacgcgtgattcaaacagcgaaacgaattgcgaagcagcgtgatttaccactcgctgtgatgacgttcaatcgacacgcgtcacaactgtttaagtcccagaccacttttcggtatctgaataccgtcgcgcaaaaaagccaacatatggcggcgctacaggtggaccgactatatattacggattttaaccaccaatttgctggcttgacaccgactgcgtttattaaggattaccttgtcgggttgaatgcgcaagtcgttgtggcggggtttgactatacgttcgggcagggtggcacaaatgggatgcgcgaactcgcggaattgggcgccccgtactttgaaacggtcacggtggatcgcttggctaatcagcagcttaaagtcagttctactcggatccgggggctgattgctcgggggcagattgaacaagctaatgatttattggggtacacttacgcgacacaggcgacattcgatccgttgactagaacgatccaacttgcaaatcggcaacagcagttaccagcggccggtgattatcgttgttggttagttagcgctaattatcgacaggcagtcattctgcgagtcaccacgacattaaaaattatttcgccataccagttgccaccggaaacctcggtattagatgtggacgttcagtggcagcagcgtgctttgcaagtggtcagttctgtctcagcccagcatcaacaatcacaatatagtaaagcttaatgtagaccaccctgatctgtttgatggggtggtttttgattgtcgtcacgtcggtaagttgttcgtgctagatcgttagcgatatttgataaaactgagtatcgggtgtgtgcttgatcctatttttctagtccatagatagtttcacatgaaataatcggataaacacaaaattggcgctgaatggtgccccgttttgtgtacttgtaatttcacttacgaaaagtaagcatattaattgcatttataattgaaagcgatttataatacgtttgttaaatgaattgaaccaagcagacaaattggttctaagtcgaagggatgaatagtgatgacaaagatgattgcaggacaagctttagttaaggttttagaggcgtggggtgtggaccacatctacgggattcccggcggttcaatcaatcataccgttgaaggtttgtaccttgaaaaggccgatattgattatattcaagtacggcatgaagaagtgggggccttagcagcctcggcagatgccaagtttacgggcaaaatcggcgtttcatttggttctgcgggtcctggtgcaacgcacttattcaacggtttgtatgatgccaagatggatcacgttcctgtattagcacttgtcggacaggtaccacaagcgacgatgaacacgaattacttccaagaaatggatgagaccccaatgtttagtgacgtggcggtatataaccgcactgtcacgacggccggacaattaccatatgtcattaaccaagcgattcgtgaagcataccggcaaaagggaccggcagtcgttatcattcctgaaaatctctcagcggaagaaatcgattatcagccggtatcgacgcctaacaccgtttcagatacgtttgaacaacgggtcgatcctcaggccattacggcaacgttaaagatgctaaaagcagctaagcatccattagtttacgctggtcggggtcttcttggtgctaaggcagacctggtcaagtttagtgaacaattcaatattccagtcatgaatacggtcccggcgacgggggttattccaacgaaccacccgaatgcaattggcacgtttggccggttgggttccaaatcggggttcgaagcactccaacacgctgatttgattttgttcctgggatctgaatttccatttgctagtttttggcctaaggggattaagattattcaggtcaacaataacagttttgatatcggcaagatggtcccaatcgattacgccgtcatcagtgacgcccaagcttatttgcaagcgatgattgcaactggcgaaacgttacctgaaacagcgtggttaacgactaaccggcaaaataaacgtaattgggataagtggctccaacaattggctgctgacgaccatgatggactagcgccggaagcggtcatgcacaaagttgctagtatggtcggccctcgtgatacctacggggtcgacaccggtaacgtctccgaatgggctgtccgggggctcccaatggatcaggagcaacgctttgccttatctggcctcttcgcaaccatgggatttggactacctgctgggatggctggtgccttaagtgttccagacagccaagcgtggagtttctcaggcgatggtggctttgcgatggtagcgccagatattatcacggaagcacgttacggcttgcctgttattaacgtgattttcagtaatcaacggtttggtttcatctatcgtgagcaagttgatacgaagcaacacttgtgtggtgttgatctaacggatgccgactgggccaaagttgcagatggccttggtgggattggttttactgttcaaaataatcaagaggtcgaaaccgtctttgaccaaatcaaggcgctccaagcgaagggcaacaagcggccaatcgttgtgaacgcggtcatcaagaatgatgatccaattggcacagcttacatgccactagatcctgaattatatggtcaagcagaagttgacgcttatgccaaagccaaccacattgatattaaggaacagccatcattaggcgccttactacgagcacagggtgatcagctatagttaaagcctgaagggctagttagaccactgggcaaagcttcagttaacctaatattattaaaaagccgccagtatcgggtatgacctgatactggcggcttattagttgttcagttaggatttatttttgattaaagctgccatcttccacgtcacgaatgaattgtttcaaatggtcaaagtagacgggggcgttgtcgatcatgtggtgatgaccaccatttggcgtcgttactaagcgtgagttaggaatatcacgagccatgcggcgggccgaagctaatggcattgtttcgtgttcaccgaaagttaacagggtcggcactttaatgttgtgaatctgatcgcgaatatcccattcctttaacttcccagtgataacgaattcattatcaccttgaaaggcgttgtatacaggagtggcagtggtgttgatcaaatggcgaattgaagtgggttgtttgcggtcaacatagccagcgttcagaacgtccacgtacttctgatactggggatcattccagttgccttccgcttccttttgcttcatataagcaacagcgtcagccggtagggcttcttcacgacacttgttaacgttgacaacgtattcctcaatgttatcgaccatacttgaaataatggcgccttttaagtgttgaccatacttgagcgcgtacatcattgtgagggcgccgccccaagactgaccaatcaagtagaagttatcgagtcctagtttttgtcggacttcttcaacttcatctaagaagtagtcgtaggtgagatatttcttagcaatttcgggatctgagtagtcgggttgatccgaataccaggatcctaattggtcgtacattgaaacttggacacctaaatctgccagttcctcaccaaagttttcccagtattcgtgattgccaccagggccaccgtgtagacataataattgaatgtcgcctttgccctgagtattcgtccataaatggtagccattatccagcgtgatgattgtcgttccttgtttcaaatgatcacctaatttcttcatattttaattgttatcttaccactgttaactaagcagggtcaaagagactaggcaatcataaagaattgcattaagtagataattggtaagttcgtgttcgctaattaactgaatcagtacggtcgcgtcatagtagctgagcatgggaggggaattcggtcgaaacgatataaaaataataattagaacgggccgtttagtctgaatttggtttatactagttattatgctggtcggtacgactgatagaccaagtttcagtcgtattgtgaccgattgtgcacaattgatttgacaagcggttacattttcagcgataataagtaaactgctcagcacagaaagatgtaatattacattctttaaattcaattgcggttagttaaccaatatgaaataatgggttaactaattagagatgggtgagattgatatggcaaatcaagtcgcagttttacgcttgttaatccaagcggcgcccgcgtactgttcgggtgactggttggcacaacgacttgcaatcagtcgaacggctatttggaaattagtgcaaggattgcaagcggcgggccatactattgagagccggcatgggcgaggttatcggtatgtggccaataatcaattgagtgcgccggtgattgaatacgcgcttacagcgttaccaccgtttgatttgaccgtgctaccaacggttgattcaacgaatgcctatttacggcggttagtcacgcagacgcctttagcacttccgaaaatcgtggttgcggatacgcaaactgctggttacggtcggtcggggcgggcattttattcgccagcacagactggaatttacatgagcattgggttaccactcagtgaccagaaggcgttagacgctggtttgttgacaacgagtactgcggtagtcgttgcccagacgctgcaacagctgtttgcggttgacgtttcattaaagtgggtcaatgatgtgttagtcaatcatcacaaggtggttggtatcttatcagaaggcatcactagtcttgaaacggggcaaatttcagcagtcattattggaattggcattaacttaacaacgacagcttttccagcgctactagcgcacaaagcgggcgcagtcgttgccaatccaaatggtgtgacgcgcaatcaagtgatttgtgagctactgcggcgctttttcaatagctatgggacttatcgtagtgggactttcatggacgcttatcggaaactctccatggtgatcgatcaacaggtcgagttgaagagcggaacgcaaaagtatcgtggagttgtcacggatattgatgcacacggggcgttagtcgtcaaattagagactggtcagagtcgtcattttagttctggtgagattactaaggtgaacctcttgtccggtggttatcatggctagcaagtttgtaaaatcaatttatcaagttaccgaacgaatcgcgtcaatcttttaaaatgatttctgattcaatgttttactggttcatactgttgtatagtagaagttagtcacaagtagtgctaatcaatttcaatttgattaattgagctgtttggtacgtcgaatcaaccttaaattgttgataacataggaatgataacggatggattaatagactcacgtttgatttatttatattgtaattaagttcggggttatatgtgtttaatcagcataatgaataaagtggttaataaaaataattaatgaagtttaaataatgctggtcaatgcggtcatttacatattatagtaaaggtaccgaagcactggtgggttagttaatatttgtagagacaattcaaggggtaataggaatatgaatgaaaatttgcggagcgtaaatatgagccgaacaatgagtcggatgaatcgacaccggatgaatccaagacgttatatcaccggatttgatggtatccggacattggcggtgctgggtgtcatcatctatcacttgatgccggcctcactacaaggaggttacttgggagttccgatcttcttcgtcgtttcaggttatttgattacggatattttattacaagatattttgagtcgggggcatgtccggatatggcggtttctcggacaccggatgcggcggctatatccagcattcgtgacgatgttgttagggacaacagcctacattacgctgtttcaacggtcattattgacgaacattcgggctactgtattaacgaatttagtctacgtctataattggtttgaaatcaatcacggtcaaagttattttgaccgtttcaatggtgaatcaccgttcactcatttatggtcgctctcaattgaaggacaatattacttattctggccattagtgattggtatcttgatggtcatcttcaagaagcgttcacgggtcttctggtttatgatgattgctgcgggtatttcagcgataaccatggcaatgttgtatgatccagcgaatacgaatcgggtgtactacggaactgatacgcggatgtttgcaatcttgttaggttctggccttgcgtttatctggccatcacgggaattatcggcggacattgctaatgttaatcgagtgacactggatatcttaggcggtgcttcgctaattgcaattatttggatgtttttccagatgtccggtcaatctgatttcacttatcgtggcggtatgttactattcacagtcctatcaacagtgttagttgcaacggtggcccacccggctagtcatctcaatcgcgtcttgacgaatccgttgtttaagtacgttgggcaacgtagttatgggatctatctctaccagttcccagtgatgattttctacgaaactaaagttaaaaacattggtgatcatttactcctcaatagtttgattgaagttgccttaattttgatcgtgacggaattgagttatcggtttattgaaaatccaatgcggcactatgattacagtcggttattggtcgacttcaaagatttcctccgcaaaccgaagtttaaccgcgtgaccactgcgattgtcgctttgaccacggtcttattcgttattacggcggttggtttcgttcaacagccaagtaaagcggaagctaacaagaagactgaattacaaaagacgattgcagctaactctaaagcggctgataagaagaatgcggcggcgctcaaacggcaaaaagctgcccaggcagcggctgcttcaagcaagaaggttgcgactgaaaagatgcagaccaagcaggctgaagcgaagttgaactcgaagcagaagcaggtggaaaaggaatacgatttgaagccacaagttgttctagcgatggccaatacggatctgacagccattggggattcggtgttactggatgtttcttccgatcttcaagatgttatcccgggtacggtggttcaaggtcgcgttggtcgtcaagtgacggaagttcctggaatcattaattcgctgaagtcgcaagggcaattagcccataacgtcctattgaacattgggactaacgggacaattacggatgatcaagctgaacaagtcgttaaactgattggtaaggatcgtcagattttctgggtaacggcccacgtcccaacacagagttggcaaaatcaggtcaatgctcaaattgccaagactgctaagaagcatgcgaacgtgcatgttatcgattggcatggtcgtgcgcagaatcaaagtggttggtttgcagatgacaatgttcatccaaatacgactggtaatcgccagttaacgaatttgattgcgaaccgcattgccgaagttaataacaattaaagatgagttccagcttacgttgatggtaagctggaactttttttggctagttccggacaggtggtggtgtccgacctggtcatgataagtggctgtttaagttgaaggtacacaaaaggcccaccagttaacggttgtgtggttagttggtaggccataattagttagtctgttatttttttcattgggacgtgtaagcgaatatcgttcaagttaagtgagtactgtaggtcttgattgccacgaatcgtcatcttcatatcagttgcgtaaatgactagtccgagttgatgccccttcagcaagtggtggaacagcggttggagatccacagaaaagtcataaaagacatttggctgaatcgcttctgcgtgccatgggtggtggcggttctgtaagttaagatgccccttagtaatcatcttgaacggcgtctcacccgctaacttgaagtccttcaaatcatcttcgcgccagtggtaacctagatcaagcgcttttgcagccagcatttgtgggctgacagtcaaacggcgcgcggccccgaagtcaatcagcataaagctcaacatgccgaaattcttattaacggcgacagagcccgcaacgtgcggaatacccactaataattgatcctcaggtgcctgccaagacttgaacaagaggcggtgatcatagagcggatttaacttatcctcttgcaagaggtcgcgctgccaactatcaaaatgatgcttatagtggtcgaataatttgtcaggcaatttatcagtaaaatgagcggcgcgttggtcaactgtatggtcagcaggaactaattctttgtactgaaccttaaaatctaaagcgtcggttgtgtcttgccaccaattgtcatagccgtgccaagtttgggcttgcgtgttgtcttgtaccaagacgttaggcaagagtgtctccgcatgattatctaaaccatataatttatggcttagccacaagttcatcatgtcggtgaaatcgagcgattgtaagttattgatataaatatgttgtccctggtgcaaaatgagctttttagtaacgggaactgcctgtaatttatcccataaattagctacgtttcggggcttaacgttccagtcgttgagcccgtgaaccatgatgatgtccgccttaattttgtcaacgttcttgagataattgcgttcatcccagaaacggttatagttaccgcttgctcggtcttggtcggcagtcagttctgccagtttctgatcaaacgcgggttggatctggtgagcgtcaccggcttttaagcttcgtgagaagacctcagcggcgagaacatcggtgtcttcgccctggaacgtatcgggagcgacaaccaggccattatctcgataatagtcgtaccagcttgagatggcggcctcggaaataatcgtcttaaggccagccacgcccgtcgtagcagcggcagttgcgagggtaccgaggtaagaccggccagtcatagcaacggcgccgttgcaccaccaagctttgatagcgatattgccatcacgattggtgaaggcttggcgtttgccagtcaaccattcaacaattgcaactgttgaggtcgtttcatcaacgtcaccggtaggggctagcccatccgagtcgattgaaccaattccagctgcatagacgacagcaaaaccgcgcgctagaaagtaatcattgagcgtgtaggacttttctcggctgaaagtctcctctgctgtatcggtcgtcgtggtcgcggttcgagcggctggtagttgcgccgttgttggctggaactcaacatccgcataggtattttcgtccggttcctttgcagtcaggggaacgtctacgttgtgcatttgagcatcaccagcttggtcgttgatgccctgattataaggactagcggtatagagaacgggaacttttaagccggtttcggtctcagttggccgaaggatttcaactttgagcaggtcccgttggccgtcgtggtcagtatctaaaggcgcttcaacgtagacgacgtcacgaatgagcgcgttggtatcaaagacggcttgggccttaccattgaagaagagtggcttttgatcgttaggtaattggtaaaatggtacaaagtaaccccgggtcgtgagtgattcaatcaaggtttgtccattattcccacgtgtatttaataataggtaccaagcataatagagggcttcacgatcaaaggcgctatcaccgaccattggcaagtgaatatcgcgcatcgccagcaatggatcggccaattcaaaatcttgaccaggtagaaaacccagtagctgaagtcccacgttataaaagacttgattgtttacgatagttgcatcggcgagccattctgataaagtgtgctggctggttgccatgatgttattaaacttgtgggtcaagccgcttgccgtgtgaacttctggtaagcttttagccagcaatgcctggtagacggctggaacagtcgtcagggcgtccatatcaggcgtaataaaatgaatttttgtaagttcggcaatcgcggtttccgaatcagtcgggacgattgcaaattgattatttttcataagtaaattccccattaagtattattagaaatattataccgctaattagtcgagaaccaatgcttcttactgacaagtttataatgttgtggtaggttaattgcaaagtgaactatcgaatggaggaactaagattgagtgattttccaattttatatacgacccaagcagttaatgaagacggcatcgaaggacacgcctatattcccaatggtcttgaggtggccgtatctagtccacttaaggcggtgccgggctcgaatccggaacaattaatcggattggcgctcagtacatgccttaacgcgacgctggaggcaatcgaaaaggagcacggccagacacatcagagcaaagtcgtgactacggtgaagatgtcgcgtgaccgttttgggtaccaatttttcctagatgctcgggtcacgattccggaagtggatgctgaaacggcagcacggtggctcgcgattgcggaaacgcgttgtcccgttgccaagctcgttgggccatcagccaacgtgacgattcaattggcttaaccgttgtgatatggccgcagtaatcattaatcgtagtttgtaaaaatgtcaggggattgattaaaacgtggttcgagttggcagcgattaaaactgccaattcgaaccacgttggtgttaatgatgactgcgaatttgcttgaaaagttggcgtaaacttgggtgctgactagtaactgctgactgaactttatcgacctgttgtagggcaagttgcttcgttttttcgcgttcgattttgagctgcttgcttagtgctcgcgatttccaaaagccgttgatgccgacgacaactggaataatgtgtaataaggttgtggcgggaatgagccagggatgcttactgaatagttgaacgacctgggtatgatgctcatgaaggtcgtcatggatcgttttaggtgttaacatgattaaaccacgctccttaattaagtatcattatcataccttaaaatgtaatcgttgtcatcgttagctggctgacaatagttaaagcgcccatctcaagttgattgatcacttgagatgggcgcttttagttagtacaaatctagattgttactcatcagctttattcatgcgactatgccgaatgccatagccaaagtaaatgatgagaccaaggaggaaccagactagggatgccagccaagtttccatggatagctgggtcatcatgaacaggcacagcaagccagaaataattgggagaaccgggtaaagtggcacgcggaagcccttgatcgcgttgagcttgggattacgccgtagtagcaaaattccaaaagaaacgaaggcgaaggcaattaatgtcccgatattaaccaagtttgccaattggtctaacggaatgagaccagcaagaattgaaatcacgattgtaaccgtcaacatggcgtttttaggggcgtggtgcttatcgattttacctaagaaacgtgggagtaagccgtcacggccgattgaatataatagccgtgagctactgtagatcatcgtaaccatcattgtgaacatgccggcgagggcaccaatcgagataataccggcaacgaagttttgatggacgagttgtaaagcgaacgccactgcatcgtcaacgttcaactgtttgtacgaaaccatcccggtcagcactcctgaaacgagaatgtagaagatggtacagatgactagggtcccaatgattccaattggcatgttgcgcttggcatttttaacttcggctgccgacgaagacacagcatcaaaccctaagtaagcgaagaagacgaccgcggcgcccttgagaattcccgtcccaccaaatggggcaaagggtgtccagttacttggtttaacataaaatgaaccgactaataagaacaatacaatgattgctaattttacgaccacaataatattgtttaatcgaatcgacgtttttaggccggtatcgataatccaagcaatcagacagacaatcagaattgcgatcacgttgatataggtcccgtgggcggggtcaaacgaaccggtgatggctttcggtaacttgaggccaaaaccagcaatgaatgaattaaagtacgcggcccacccaacggcaacggtcgcaacggctaggacgtattcgagtaccagagcccaaccaatgatccaaccaatcatttcgccatagacaatgtttccgtatgaatacgcggaaccggcgattgggagcaccgaagcaaactcggcgtaacacattgcggcgacggcacacacaatggcagccaaaacgaaagataaaataatcccgggtcccgcttttgttgcggcaaccgttccgggtaggatgaaaatcccggtcccaatgacggcaccaatcccaagtgcaatcagatcgactgcggagagggttcgttcaaaatgactatctttttgtaaatagcgctccaaatcttctttttggaaaatgcgctggaaaatccccataacatggaccacctttttggttatttgtaacagttagttgtcattatcgacaaatcgtcatgtcaatatgataccgtggttgattattaaaagtcaattagaatcagccttttattattaataactcaatgggatacggagcaagatagctggttaatcatcatagaagctggtgacattgcgactgtcgaggcaatgttcgtgctgacaatagatttgatgacgataacgcgtaaccagtcatggtggggatttaaaaagcgttgtgatggccgaattactagtcatcacttaagccggcggtaacggtgctaagctgaagagaaacgggtctgaatatgcggttgggtagctgttactattgttatttataagttgatactttgttataacgaacggtagtcaaagaatacacacggataatacattaaactgttaattggattcgccaaagcttataatattgttatcaatagaaatttaattttagaatggtgggattaggatgggagcggcgattgatattaccggtcagcacttcggacgcttaatagctgttcaccgagcgggccgggccaagaatggtaatgcgctctggttttgtcagtgtcagtgtggccggacgtgcgtggtggattcctacgttttgcggcacggcaagacgcgtagttgtggctgtctagccgtggaacagagtcggcaaaatatttttaataatccgcaagcagtttcgcatatgggggacccgcgtaatttgaagattcgtgatcaccatacagatgtgagttcaatcaagaagtcgaagcgtaacacgagtggggtcgtgggcgtgagctatgacaaacagtcaggttcctgggttgcgcacttctactacaaaggaacgtacatattaaacaaacattttgcgcattttgaagatgcggttcgggcccggcacgctatggaacagcaatatttaacgtcatctgataactgaaactgtcggatgcccacgttaggattcactagcaaattgtaggctagctaatattgtggataatatttgaaggaactgaagtcggttaagtgtcgaagggcttcgacgtaatgtgtgcttagtctgatgaggatggatgataaattttaatgagttgaacaacgggactggcaatccgctgctcaactttttgagtcggcactaatcaagcttaatgatgacaataccgttgcggtttgcagtgatgagtaatcaatgcccatttgagtggttgatttaacctttcttttgaagcgaagaggttacagtcagtcggagttctgatagaataagcattacacgagataagagggggtagcaagattgtcaacaatgttagtggcggaagatttatccgcagtcggtggaatctcacttagttcagcgttgcccgtattaacggcgatgcagtatgacgtggcagcactgccgacaagcttattatcgacacatactagcgggtacgggacaccagccgttgtcgacttatcgacgtggctgccgcaggtctttgcgcattggacccgtgcacaactgcattttgatcaagccctgatcggctacgttggttcggtcgcactgtgccaacaaataactacttacttagaacaacaaacgctgtcgctattagttgttgacccagtactcggcgatctcggtcaactctatcagggctttgatcaggactatgtcgcggcaatgcgtcagcttattcaacaggcggatgtgattttgccaaacacgacggaggccgcattgctaacgggagcgccctatcaagtgacgccagatttagaagttattttgccagcactgcaagcacagttgaaaactggcgcccacgcagtcattacggatgtccaacgtgctgatcagattggctgtgcctggttggatgaagctgggcacgtgcaatactgtggtgcgcgacgtttgccggggcattataatggtaccggtgatactttagctgctgtaatcgcgggactgttgggccggggttacgcgttagcaccaacgctggcgcgcgctaatcagtggttgaatatggcggtagcagaaacgattgcacaaaatcgaacggatgaccggcaaggggttgcactgggggacttgctccaggcaattttagccctcaattgatgatggaacatgttatactagagcataattcataattaggaaggtgcgacttcatgagtacagaagtagctagtggtgcggtcgtctatcaacaaaaagatggtcatcccgcttatttattattacagagtgcgaccagtgatttttggggctttccgaaggggcacgttgaaggcaatgaaacgttagctgaggcggcgcgacgtgaaatccgtgaggaaactcaaattgaagcgacactcgataccaattttaaggcgtataccgaatatgacttaccgaatggtaatttgaagcaagtcacactgtttgttagtgaagtcccaagtggtgtcgtagtgacgcggcagcaagctgaaatcagtgcaattggctggtttgattatgctgctgcccgcgaacgattgacttacgataatttaaagcaaatgttagatcaggctaacacctacattgagcagcatctacaataatactgactgtaaaaaaattactggtgccgtcgcataaacggtaccagtaatttttaaacaatatttttagattggcttaggcctgggtttgtaagtttgcaactgcatcttcgattgttacgccttcagcgaacaattctggatgaagtttgtcagttgcgacaaacatttggcgttgcgtatctaagacaatgctgaaccagctatttgttttttgaaattgcatatgacaaaactcccttctgaaaattgttggtttgctacgagatgcgtgaatcatctatttgaaccttataggtacgttactatactcggtttaccgagctaacgcaaatgaaaagctttacatgaattaaaaaatggaggtttatcaactttgacaacgaaacggatctttgtgatcacgggaccaacggggagtggtaagaccactgtcagtcattacttgcggtcacaataccaaattcctcaggtgattactcatacgacccgggctccccgggaaggtgaagtcagtgggcgcgactattattttgaaactccggcgagttttgtcacgaaacattatttagaacacgtgacctatagtggtaatcaatacggttcttcacgagaaggactagcggcagcctgggaacggtcaccactgattagtatcgtcttagatacggcgggggctattacctatgcgcgggagttgggcgaacaagcggtggtgatttatctcgaggttgctgatcaagaggcgctaattcagcgtttgaccaagcgaggagatcttcctagccggataaaaaagcgagttgctagtgatgagtatttgcgggaccaggctttgccagtaggattagtggggcatgcacatgttatcgtgaatgatgattggcaggcgacgcggcgccaactagatgagctggtcactgaatattgtcagcatgatgttgtgacgaaagattagcgctgacgtatagacggtcaacgtaattcacttttacacttgagtatgctaaactaaatagtaatgattatgatttagtgaagtcctggtcagtaggaggcagcaacattatggaaacaccaattgaacaagccgtcgcaattttacgtcgcaatcagtttaaaattacgaagcaacggcaggcattattagattatctggtgacctatcaggaccactatgtggcaatttcggccgttgatgagcacatgcggaccttatttgcaggaatgagtcacaataccatttatcgcaatattaaagagtttgaaacgttaggattattggaattgaaggcccaggctaatcaaaccctggttaaatatcaatgtgatttcaagcatcaacaccatcaccattttgtttgttcaaactgtggtaaggtgacggaactgcaagcgtgtccgttagacgagtatgaagcacaattaccgggttgtacgattacgggtcaccgcatcgagatttacggtctatgtgccaattgcacgaaaaagcaggcaattaatagctgacggggagtcggcttttttgttggccttgtttgagtaaagagtttcttaatttgtgatagaattagtgcattccgaacacgagcatggtttaattatagattagaaagaataacggcaaagcctcagaagggaatgacatcgatggcttatcgaacaccaccatttatttcaccatttgcaattgtttcaattgtccttgcactgggggcaactaacgtggtcgttaataagacaacccatactgtcaatggcgccaaggccactagcagtgtggtcaaaagttcatcagctagttccgcaagtctgaaaaagaaagcggctgatgatagtagcgatgagaataaatccaaagacaaatccagttcagatacatctaatgatgaacagaatagtagttccagtagtagtactgacgagaatgatacggacagcagcagtgctaataagaccagtagttcatcaagttcagctgatgatacgagttctagtgccactaatagtagtacgactgataacaatagttcaacgactgatacgagtgacgatgatgaaagctctgctgctgagtcatcaagtacgaccgcgtcaagctcgacaacgacaacgtcacagtcgacaacggataccactactagcgacgggggcgaataacgaatgtttagtattttagatatgatcaaccacgccttgggttacgttaatgtcaatgtgaagattaagaaccaaatctatatcggcattggaattgcgggtaatttatacctcggttatgtggcaattcgcttgatgcagaatggcgcgtggttacggggtatcttatatatgctcgttttcttggcgctgatttatttcattacgttaaacgtcatttattattttactaataaaactgcgaagtatgacttatcaccacgtattgaaaaattgttgggtggtaagcctaaagaagcgttagcagctgaaaaacaagcacaacaaagtcagcaacaaccatacattcctgcgaacggtatttttgatgggcaggaattgttgcccgccacggtgaagacttcacgtgctgaacaggagaatgtgcatcaaattgttgatcaactacaagcggcgaacattgtccgattagattacggtggcttaactgatgatgccatcattcagcaggcgcaggcaacgggtgaacccgtttatgcgattgggcaaggcattcaaattcctttttcgcagttaaaattggagaatcaccggctagttatttacgccggaatcaatcagatggaccaatccccggttgggcatattactaaggtcggcttgaccgatgttcatgatgcgcatgaggattataagttgtacttggcctccacggtaatcacaggtggtatgagcaagattgcgggccgaacgtcggctatcgagcaaccgggcgattaccaggtaaccgcgcaggttgcgtatgagggaagagaagattaagagtgcttccaaaggcggttagtttgtgagcattaacggtaaaacggtgatcatcctggttttggatgatcaccgttttattgttaagcggagcaaactgcctttggaagcacgtttcgactataaagcgtgaacagggctgataatcctgggcttggattatcagcctaacagggttaagcggaactaactgtgtcttttagcacgtttcggcaagctggagttaagcggagcaaactgcctttggaagcacgtttcggtagccaaattgaatctaaacacaaaacaaccgttttgagcagtggctcgaaacggttgttttgtcggtatggctatttaaaaagcgctaaaatgtctaatggcttttggaagcggtgggccactttttgatggtcggcgttagggtccattccccagactgccagtccaaaatcaacgttagcggcctgggcagtttgttcgtcactgacggaatccccgatgaagagtgcgttttgtggcgcaacgttgactttttcgagggctgtgagtagggggaggggatctggtttgcgcttaggcgtatcgtccgcactgattgtgacagccatccgcatcatgaatggatacgagcgcatcccactttctaattcgtttcgtcgttgggaagtcacgattccaagtcttagttcagacggcaactgttcaaagaggctggtaatgcctggataaagttcaatctgatcataatggctggccatgacatcttcgtattgggcctgaaagtggtcaaactcactggctgcaatccccaattcagtcattgcttgttcagcggccatgggaaaagtcttctgcgcttgggcaggactaaatggtttgccataagtagcaagtacctcacgcataaccgtcgtgtaagctggttggctattagtcagcgtgccgtcaatatcaaacattaatgcttggtaagtcatataatcgttccttccaaagtagatttaactccagtatagcaaattcgtccttgacagtggttaggacaaccattatagttagattaacaattgatgaggagctaatgatatgtcattaccgttaaattcattaaaatctagaactagcttttacttttggtattttcgctagtgtttgtgccggctgcagaggtgcaaacacgaatccgatgtttgcatcgatgcggttgccaagagtattttgtgatttgacggcgcccatggatgtttgaaaattccaagggtggctaataagtttgtttctgcgtggtggcgcaccctttggaatttcaaggggtgcgcttttttgaccctagtccagtccgcttccaccaacaagatcagccaaacttgggaggaatctttatgtcaattaattcagaaacacttgttaaccatatgaatcatgaaattgcggcgattcagccgtctgatattttggcgttcaacgctgaaatcgcaaatattccgggtatcgtgcgtttgaccctcggtgaaccggattttaatacacctgagcacgtgaaacaagctgcaatcgaaagcattgaagcggatgaaagccactatgcaccctcgaacggaacgttggccttgcggacggctgccgctgaattcttggccgctaagtatgatgtccattatgatcctgctagcgaagtgattatcacagctggtgcgaccgggggcatttatacagcgttgacttcaatccttaatcctggggatgaggtcctgattccaaccccaatttttccattgtacatcgcaatcgttaaattagctggggcaacaccagtcttcatggatacctcggacaatggcttcgtgttatcgcctgaccagttacaaacgacgttagcagcccaccccaagacgaaagcggtggtccttaactttccttcaaatccaaccggtgtgacttaccggcatgatgatctgaaagccctggccgcagtgttagctgatcaaccaatttttgttttgtctgatgaaatttatagcgaattgacgtatggtgagcctcatgaatcgattgcaaattacttaccaacacaaactattttgcttaacggcgtctcaaagtcgcacgcgatgacgggctggcgaatcggcatcatgtgtgcgccgaaagctatcacagcacaactgggtaagattcaccaattcacagtgacttcaacgacgaccaatgctcaagcagctgcgacggaagcattgaaaaatgggttagatgatgcccaagtaatgaaacgggagtaccaagaacggcgcgattatttgtatgatgcacttaatgaccttgggttccaatcagctaagccagaaggggccttctatctcttcagtaagattccagccgggttgccacaaaatagtatggctttttgccgtgaactagcccatgaagcacgtgtcgctctgattccaggtagctcattcggcccgggtggtgaaggctatgttcgaattagttatgccgcttcgatggccgatcttaagacggcggtcacgcggatcaggacgtacgttgccagcaagaagcagggggcttaaagatgaaaattttaatgtatagtgttcgcgatgatgaacaggatgcgattcaagcgtgggctgcggctcatcaaattcaagtagatacgaatgatctggaattccatccagaaactgccgacctggtcaagggttatgacggcttggtcattcagcaacgcagtccaattggtggtgatgctagcttataccaatcattagctgcggccgggttaaaacaactaacgagtcgtacggctggtgtggatacaatcaatattccggcagccaaggcggctggtcttgtggtcacgaacgtcccagcctattcgcctaattcagttgctgagatgtcggtggcacaaaccatgcgcttgattcgcaacttggaaatgtttgatcaacgaatcagccaacagaattttcagtgggcgggactgcaagcacgagaaattcgatcattaaccgttggtattattggtgcgggtcgtattggtggcacggccgctcgacttttccacgggttaggtgccaaggtgattgcctatgacgtggtacgccatcctgaactcgaagacgttttaacctacgttgacactaaggaagacctattgcggcaggcggatgtcgttgatttacacgtggatttgaatgagacctctgcggggttgatcgatgcggcagccttgaagttaatgaagacggatgcctaccttatcaacgcctcacgcggaccagtgattgtcaccgatgatcttgtggcagcgctaaaggccggtgaaatcgccggttgtgcactcgatacggttgagggtgaaaatgggttatttaaccaaaatcatcagggtgaggtgcttcaagataccaacgtggcacaattaatgcagatgcccaacgtcattatcacgccacacgtgggtttctatacgaatttagcggtcaaaaacatggtcgatattagcctggatgacgtcttagcaattctgaatggtgaaacgacggcccacgccttttaatgatggcgtcagccgctactaccagtatggctgtaggagacggtggctggtcaaagtgccccaccggttaacttgttcggcgactcgctgttcgataactagcttatagcgggactaatttggtggtgcgtccgcgactgggcttcaggtgtactggcaatgaaataagccttccaagcatattgcttggagggcttatttgtctcttgagtcggctgactggtcgtgactaactagctagtagattcggctaaccagccattatctaataactggtgatagtgcttaccgattggcacccacagtttagcttgcagaatgctacggagctcatcccagaagagtggatcgcgttgttcattggtggataaattcaattttaagtaggcccccgtctcagtcttgacaatcacaaagggataaaagactttgataatctgggccgctataatgttagtcatgttagctgcttggtcaagtaacatattatcgtctcccgttacaatgcagatgattaatttcttaatagttctaggttagcagtgattattaaagaaatgattgcggaagcgttaacaatttttaaagttcagttagttaaaaccactaattgtgaaaattatgcgccggacgcttcggtggctttcagtagtggtatgattaaaagcgggttaagtttagttgttaggtagattgcaaatttaatccgaatttttggacaaatttgtcagcatgacctgataaggtgtttgccagtcaagtattttaagtggtctctgattaatttcgagtaaggtggttttcaagccttgagcactaatgtgctcaaaataagtccccttaggataaaaatagcgtaagttccgattaaatcgttcattactgccgcgctcagctggcgtataagcatggcagtaataggtcttaataccgtattgtgcttcaagtgatactagaccgctaaactcagtgccacggtccaccgtaaaactatgcaccgggccattaaaagttgctagaaacttatttagggcttcattaacagttcctgctgtccggttttttaatcggtaggcccaaaggaaacgtgatttgcgatcgattaaggttaataaaactgccttactatgcccacgggggccaacaattgtatctaattcaaaatcaccgatgcgattacgtcgattaaccacgatgggtcgctgttcaattgaccgtcctaatgattgattatatttagaacgttggtcaaggttacgccgttggcgcacgccatgttcaggcaaatcatttaaagaaaactcaattttcccttgatttaaccaattataaattgatttagtcgctagtttaaattcgtgagctatcatttctggtgaccaacttagccgtaaatggtttaaaattatttgccttaatttgtcattcaatttagtctttcggccacatcgtgaccgcttgtattcggcatctgtttgggccacttcggcctggtaaggttcacatcgagctaattcataagaaattgtggcaggtgatcgttttaggcgatcgctcatttggatattggacaggcctagttcacaaaaggtttcgattttaattcgttcagaataggttatactagacaaaagatcagctcctaaaagatgtgtttgtggtaaacaccattttaaaggaagctgatcttttttgtccgaacagcgttcggattaattttacaatctaccgttagaataatataaattttattgaaatcattgtctaaaaattattcggccgtggcagttccaaaaagaaaagcgaattattattggcttttcacgaataatgttcaatattggagctgttattcagctattttaactgaaaacagtgtagctgtttctcactattttatggatatcgaacaatatttagctactttttgacaaaattactaattatgtattaaactatttaaatagcattaacgaagaataaggatttcttaactctaattattaatgcaataattctagaccgtcagtcaacaggctgatagagaaagcgaaggtgactgcaatgtcaatgatcgaatttcacgacgtcgaaaagtattatggtgattttcacgccctcaaaaatattaatttaacgattaatgaaggtgaaaaagttgttttgatcggaccatctggctcaggtaagagtaccttgattcgaaccgttaacggtttggaacgtgtccagtcaggtcaattgttagtcaatgggtttgatttagccgaccgcaaaacggatatgaataaaattcgcaaaaacgttgggatggtgttccaacactttaatttgtacgctaacaagacggtgcttgaaaatatcatgattgctccccggttagtcttgaaacggccggaagatgagaataaaaaattagcgatggacttattagatagtgtcggtctggctgacaaggccaatagcttaccgagccaattatctggtgggcaatcacaacgaatcgcgattgcacgttctttagctatgaagccgaagtgtctcttgtttgatgaacccacctcagcactagatcccgaaatgatcgatgatgtgttgaacgtgatgaagagtgttgccgaagactccagtatgaccatgttagttgtgacccacgaaatgggctttgctcgtgaagtggccgatcgggttattttcatggctgatggggaaatcttagaagatgatgctaaagaaaagttctttgatggtcagccgtctaatgaacgggcccgtcaattcttgagtaaaattattacacactaatttgtaggggaggaccacgaatgaagaagctgaaacgactaattggcgcactcggcatgcttgccatgctagtggtggtcttaaccgcttgcggttcacggcaatcattagcaaaacaggatgttttgaccaatgataaagctagtaagacgattacgtggggtgttaaagctgatacgaaattatttgggttgatggacgttaaagataatcaaatcaaggggtttgacgccgacattgcgacggcattaacaaagcgggtgctcggtaagaatgctaccgccaagtttgtccaagtaacgagtcaaacgcggattccattgttgaagaatgggaacattgatgccattatcgccacgatgactatcacgccggaacgtgaaaaacaggttgattttacgaattcatactttgatgcggggcaatcactgttggttaaaaagggcagtgccattaaatcagttaaggatttgaataagtcgggcaccaaggtccttggtgtgaccggtgcaaactccgttgagaacattaagaaagcagcgcctaaggctaaggtgttggaattatccgactatgctcaggcaatgacggcgttgaaatctggtcaaggggtcgcgttgactactgataacgggattctttacgggatggcgtcgcaaaacccagggtacgaagtggttgggggtaccttcacgaaagaaccatacgggatcgctgttaataagggtcaggaaccgttaaaaaaggctctgaataaagcgctcaaagaaattgaagcggacgggacgtacaaccgcatcttgaagaagtggtttggtaacgtggccggcttcgactataaggaggcgtcacgctaatgggatacattctaacgcactattggtcagagctgattcaaggactcggatatacgttgttatccagtgtgattgctttggtattcagtacgatcatcggaacaatgtttgctatctttgaagttttgccaagtcgtacgatgcgcatcattggtcgagtttatattgaaattttccggaacattccattgttagttattgcgatgttcttctacgtgatcattccaatgtatgttgccaagattgatggctttaccgcggggacaattgggctaacaatctatacctcgtcattcattgcggaaacggttcgggccggaattcaatctgttgatcctggacaaatggaaggcgcccgtgctaatgggatgacgtactggcaggcaatgagtaaaattgtcttaccacaggcatttaaaatcatcattccaccgttgggcaaccagtttattaatctggtgaagaactcttctgtcctagctttcgtggctgggttcgacttgatgtatcaagcaaattcaattgcgtcactatcgcttgatacgatcaatagctacgtggtcgtaggggtcttttacttaatcattacgttgccactgagttattacatgcggcacttagagaaaaaattagcaaactagaagggggcgacgattcatgcaaaactttattcaagcgtattcgtggataaatatccggttcttgctcgaaggactctgggtaacggtggaagtgtccgtcgtttccatcattgccagttttattatcggttcagtcctaggggtgcttcggtacgtcaagattaaatatttatcggcagtggttgggtttgttgttgacattattcgaaacttgccattgatcttaattatcttctttacttactttggcttgccacacttgggattcaagcctggtatcattttcgcagccatcctcgctatgacgatttttgaatcggccatgttagccgaaatcattcgttcagggattttggcggttgattacggtcagatggaaggcgcccgggctaacgggatgagctatgtacaagcgttatggcacattgtctttccacaagcaatcaagaagacgatcccaacgattgtgagtcaatttatctcactgattaaggatacgtcgctggcaaccattattgtcttacctgaattattaaaccatgcgcaaattatttatggtcagaactcagcgtatattttaccgatgttcttaatgatcgcagtcatgtacttcattatttgttacgccttgtcaattctgtcacgtgtgttggataagaagttagcgtaattaaactggtgggatgatggctgaaattccttaatgaaaagaccaaacaagcaataatgctttgtttggccttttttataaaaaatatttaaatgtcttgcaaaaaatagaaggcgtgataatatagttaaagaaaacgttttctataaaactgaaattaaggattgtaactcatactctttgaggcattaccttttacttgttgaaatatacgggtgaagtgggtgcctcaaggagtttttttgtattgaaggaggttcagtgatgtttggaattaaaagaaagaaagttgatgtcttcgaggtggttacaccgattgaaggtatttgtataccgatcacggccgttatggatgaagtgtttgcaaagaaaatgatgggtgatggatttgctattaggccgagtgaggacactaatcaagttgtggcaccgattagtgggaaaatcgttgcattacctgaaagtaaacacgctattggcatcatggatgagactaggggcgtgtctgtattggttcacattggcctagatacagttggcttaaatggtagaggctttacggcacacgtcaaattaaatcaagaagttaaagcagggaccctattagtgacgctcgatcgccaaacgatggcgatcgcgggattagatatgaccaccatagtcgtctttacagaaggttatacgggcgaagtgccacttggcagtaagtttcatcaacaattagcagccggaacaccagttttaaagcaagcataaactatgtaaaggagtgcgaattaaaatgcgggtggtgaagaaaattaataacaacgtggtcgtttgtcttgatcaacatggtgaagaattggtcgcctttggtaagggattaggatttcaaaaagtcccgtatgagcttactgatatgactaaagtgacgatgacattttataaattaaactatcaatattatcaattactaaaagaaatacctactgaaatctttgatttgagtgcggcaattgttgagcgagcgcaggcactaattccaagaattttgaatccaaatatgatttttagcttagctgatcatattaactttgcaataacgcgactaacccattataaaagcgcccagttaccattttcatatgatgtggagcaattatacccacaagaaacggatgttgggtattacgccgtcaggttaattaatcgacggctaaatattcaattaccagtttccgaggtcacagcaattgccatgcattttgtcaattctcagactaatgatttagcgaccaattcaagtgtaaatagcgacgatgaaatgataaaaatcatcacaaaaattattgaacaagaatatgagcttagaatcaatcaaaccgaattcacatacaaccggtttgtcatgcatttacggtattacattaaacggatgaagaaacatgagcaaatttctgaaaatgataattctaaattattcaatacgatgaggcatgatgagcctgaaatttacttggtagcaaagcgaattgcagactacgttgatagtcaacttgatactaatagtaatgatgatgaacttttctatctaatgatatatgttaaaagaatcgttaataaaataaatactcaagcgtaaccgttaattaatggaggtgtatgcgacatgaaaaataaggataaacagtatgaaaaagtggcgaatggtgtactggaagcagttggtggtagtgcgaatatttcttcggtgacacattgtatgacccgattacgttttaatttgaaggatgaaagtattcctaatgatggtgaggtacagaatattccaggtgtgattggtgtcaatcgcgctggtggccagtatcaaatcattattggacaagcagttagcaaagtttatgatgcgttacttacggtggggaatttaactagaaacgcgccaattaatgaagatttagataatcgacctaaagaaaagttaacgtttaagtctgcgggaaatatgattctaaataaattggctggatgtttaacaccattgattccgatgttgattgctgcatcaatgtttaaaatgtttgcggccattttaggaccaagcatgttcaatgttcttggtactaaaacatcgttgtatcagttatttacgttggttggtgatgctggattctacttttttccaatcatcttaggatatacagctgctaagcaatttaatacgtcacggattatttcaatgtttttaggtgcaattttgattgatcctaatttaattaaaattgtgactgctggcaaggcatttaatatcttcggtatcgcaatgccattagttaattattcaagtacggtcattccaattattttgtcggtttgggtaatgtcgtatattgaacggttctttaagcgttatgtaccagagtcgattagtacgattgttatcccaacgttgacgattgcaatcatgttgccgatttcgttatgtattttaggcccagcaggaaactttatcggcaattacatttgtacaggaatattggcttttggaaaattaggtggcttgccaacgattatcgcggttggagtggttggtgccttatgggaaatcttggttatgaccgggatgcatctcttaatgcttacgacgatgatgatgatttttgcgcaatcgggtcatgaaaactttgtcacacttggcgcagttgccgctagtatgtcggtcgcgggcatgtgtttgggtgcggccttacgaattaaggaccaagatcaaaagacacttgcttggggttatttaatcgctagtattatcggaggtgtgactgaaccaggattatatggactagcaattcgttataagcgaccatttattggcatgatgattggcggattttgcggtggcttatatgctggcctgacaacagttacagcttatgtcatggtacctgttgcaaactttttatctttaactgcgtatgttggcgggcaaacatctaatgtgattaacggtgtggttagtggcgtgattgcgtttgtagcagctgctattgcaacttatgcgattggtgttgaagcaaatacaaacaaacaggggactaaagaatttaaactagtggaggcttaaaagctaatggaaagaaaagtaatcgttcgagctgatgatttaggttattccgatgcagttaatgttgggattgcacgaacagttcacaacgggttaattaatattgtgggtgttatggtcaatatgccaacgacgatgtcaggattagccatgattaaagatgcaggggtttgcttaggtttgcatactgttatatctgctggccggccattaacaaatccaaaattgattccgagcatcactaatccagatggtacctttcgtcattcctcggattatcgggcggctattcatgattttgtcgatcttaatgaagttgttttggaaatcgaagcgcaatatcaaaaatttgtagcgttagttggtcgccagcctgattattttgagggtcatgcggtagttagtgataactttgttaagggattggagattgtgggtgaacgtcatcacttaaatcttttacgctttgcagcaggcccagatagtccgagtgtgctatttaagggaaaggtattacatgtttttatggaaagtatgggcaaaaactataacccttatgaaacgttgaaacgtgcggcactagcccaatataatgacggctatgctatgatggtttgtcatcctggctatttggatgactacttattacaacattcaagcctgacagttccccggacgcaagaagtcgcaatgttaacagatcctcaaatgcaggaatgtttagaacgacagcagatcaaattaatcaaatatagtgaggtttagttactaagcgttaaggtaatcggtaagcaaattaaatcacttatttcaatgcgcgttgaaaagcataaaaagagcgttgctactgaaaatatcttcagtaacaacgctcttttgcaagttatcaagaatttaaattaagcattttgattttgctgctgcttccaataatagattgggaacccaacggccacgataaccaaggaaatcagtacacccgataagtctgagccaatttcactgataatcacgaacagcgcgcccagaatcgcaatcagcggtgtgatcggaaatccaggtgtcgagaatggtcgctcagaagctggacgtcgttttcttaaaataaagacaccaacgaaggttgccacgtagaagcagtagaccgtgaagatacagaggtccgataagcgatctggattgaagaacaggatcataatactagcataaacgagaatggcaatgattgcggcgatcggctcgtgtgattttttgtgcaagtaactgagttgtttagcgaatggcagctgattctgagcagccatggcgtacacgatgcgggggaaggtcataatcttgccgtttaaacagcccaccatcgagatgataatcccaatgttcagtaggcgcccgccaattgtgccaaacgccgcttgggcaaagtacagcgtcgtttgttgcccgagtttgtggatcgttgccgcgggtacgaagtggagaatcccatagctgactaaggtatacgcaatcaagaccattgaaatccctaaaataatggcttgtggtaataacttctgcgggttcttgatttcgccacccaagttagcgactaagatccagccatcataggcaaaaagtgttgcgaggacggcaaccccgaaactacccgttgattgggtaattgtatgtaaagactgtcccagcgcgttctgattaccatagaagagtccaaaaataataatagccgcaatcggtaataatttgcccaacgtggtcgcaatttgaaatgcggcgccccaacggttttcgaacatgttgaggattccaatcaggacgatgacgccaattgaaagtggcgcctgccaacccgcctgcaggttgaagaaaccaactagtaatataccgaggtaagcgctaattgaagcgatgatagcgggaccgtagacggcgatttgcatccaaccagagagaaagccccacaatttaccatagatttgttccatgtagacatagagcccgcccgtatgcggcatttgggcaccgacctcggcgattgttaagcccgcggtcaacgtaatcagtccacctagtaaccaggcgagtaacgcagcgctcggtgagcccgcactatcaaggactgatgattgcttgaagaagattcctgacccaataaccgtaccaacgacgagtgaaagtgctgaccaaaaaccgagtgaacggttcagggtcgttgcttgctttgtttcctgcattaacctgaaatcctcccttgaaacaaccaaattctaaatgattgcacttagcataccagagattaatggtgatgacaatcaaatatcgttgattgtggccggctttttgcccaaaatccgaactaataacgatattttaataataaagttcgacaaggctcaaaatgatcagtgttattcggttggtgattcgagtttcgacaaaataggattgggcggcgtggtggctttaaattaatttatttatcttcctaatattagcagggttatttaacgggtcaggttagtcattaacttagtcattaattgagttagttgtgcccactcggattgattgagaccacccttagcagtcaataaatccggcaaatcatttaaagcaagtcgtgttgcggttccttgaggtgtcagagtgagcaagatgctccgttcatcttggggattccgatgacgtgtaattaaaccagcttgggtcattcgctgtagcacgggcgtcagcgttcccgtacttaaatttagctgggtgctcaacgttttgaccgtgacagcgcgcggcggtgtcgcatagagtgcgactagaaccaagtattgtggataagtgagtcggtgtgctgtcaaagttggttggtagaggcgttgaatagcatggactgttgtgtaggttgaaaaacagacgtggtcttcaagggggcgaattgtggttgtcttcatgataattaccgcctttcatgcgatgagtattaagtattaagtgcggagacgttctaataatgattgtacacaatcgattgactggattatagcacattctgacaatctgtgggcctagttgccctagtgccggtgggatcttatggtctggtggtcacgttcagtatgcaaactgatgattgtgggtaccacttgcagtgacgtcatggtaataatttttggttccttcctaaaaatacagtataatgctacgagtaggtaagagagtggggttagattgatggtaattgcaattgtggtgttgttgatgctgctcagcatcggcttatttgggttgctgttagccggtgccagacggcaagcagcgccattttttgaccacagttttggtttcggcatggttatcggggccgtgacggattttcttgacacacttggtatcggaagtttcgtcgtgtccacggcaatttttcaagcgagtcattatttaaaggatgaacgtaagctacctggaactttgaacacgatgcatgcgattccgaccgcgtttgaggcgtttttctttgttacagcagttgcggtcgagccagtgacactgattagtttagttttagcagcaacgctcggcgcattactgggtagtgaagtcatgacgaagcttaatcagcggtggattcagttaatcatggccggtgcgttagtcatcactgctttactgatgacagcgaagttattaggttggatcagtttgctgggagttgctaatcaggcgacggggctatccggttggaaattattggtcggcattggtggcaactttatcctagggttactgatgtcagccggagtcggactgtacgcaccgtgtatggtaatggtgtattttctgggattgaccccgattgccgccttcccaattatgatgctgtcgtgcgcattgttgatgccgatttcggcagtgaattttattcgccatgaccgcgtcgattatcgcggcttattcggcattattttaggcggtattattggcgtggtggtggcagcgaccttagttaagtcactgtccttaacagccctgagttggttgatcgtcttagtgagctgttggacggccttttcgttatggcgtgccgcgcaacgccggaaaaatgtgttatagtcaacggtatgagtggttaggctaaccaagcctagccacttttttgtcgttgtttaaaatgattttcaggctgctagaaaaaatagcggtcgctggttgacaatttatacagctggctgtataaataaaagggcaggtgattaagatgaatcatgatgaaatggtggcgcggcaagttctgattttagctcgtcaaatcaagcggcgtcgcaaccaacatttgcggacggtggggttaacgactgagcaagcggatgcactgactttttttacggatcagccaggtcgcacggtaaccgcgtttaagacgtaccaggaaatcacccatcagacggccaggatgatcgtgcaacgcttgcagacgcgcggatatgtccaattagtggtcagtccaacggatgcgcgtgccaagcaagtggtagtgaccccgagtgggcgtgctaaacgcgagcagctccgtcaacatggctggcagacgagtgcgcaaatgtttgcccatttggatgccgaacaacaacaggtatttttagatttgttacggcaagttaatcagaatttagaaagtgatgagaattgatgaagacgcgtttatatacgccggatgtaaagttagtgttaatggctagtttcttctttttaatgagtccaatgttaatcaatcccgtgattgcaggatttgcgcacggtattggcgctagtagtgtgcttgccggtacgattgccgggttaacgaatttgacatcgctagtgctccggccacttgctgggaatttaaccgaccgggtctctaagtaccgtttgaccttcgtggggggctgtttgttgctactagctagtttaggttatagtttgacaaccaacgtgacgttaatcatgttattgcgaattttgaatgggttgggatataccttgtgttcagtttgcatggcaacctggatggctagtttattgccacccgatcgaattggctctggaatgggcatttatgggctagcgaatgcgcttggaatggcgtgcgggccggcaatcagtgtcttcttgtatcaacattacagttaccagagtgttttttggttagcagcgggctgtagtttactgctcatcatcatgattcaattcgtcggtgatcatggtgaaccaattgtgacgcctcaaacggctacgactaagcaccatattcgcatcgtacaaccacgagtaatccccgtggccttgattttgcttttattttcattaccatattttgccacccaaacctatattgtcagctacgtcgctgcacggcattttcatgtggcagcgggggtatttttcccggtgtacgcgggtattttattagtattgcgaattattctccgcgattggttcgaccgggtgccatttaaacggttcatctggttatgcttaatttttaatctattaggattgattggcttaactgacatgaacaattgggcgatgctactgctgggtgcagcaggactggccgccggatacggtttgatgttttcaatttgccaagctaaagcattgatgctcgtgccgaaagctgatcatgggctagccaatagtacgttttatattggtgttgatctcgggatgtcacttggccccatcattggcgggctgattagcagtcaattaccaatggcgtggttttatcccgtgatgatggtgacgctgccattgattatcgttgtttacctagtcagtcgtcggcagttagcttagccaccaacatgctggagaaggttgttcttggtatacacatgattatgaattttttcagtaggggatatcaaaaagtcacttcaagtttacgactgcctgaagtgactttttatctgcctttatataaacattttgatgccaaaataaataataataagaccaagaaatggcgttaatacgcggttgaccttatctaaatttaaatggcgaatcacgagtggtgtaatgattgcgccgataattgcgccaatcatgaggaccaatcctgattgccaagcaaaagtactagtaaagagatggccgattaaactgattgtggacataacagttaacacataggtggcagtaccagcggcttcaacggccgttaacccaagaattgctaacccggcagccgtggtcgcaccaccgcttaagccgccaatgccgaccatcaatccacttaaaaggccaaagaaggcagcttgccaaggttggtgaccggctgtagtttgtttagaatggtgaacatacttgattagtaccatcgcacccataatcaaaaaaattgtcccgacaatccagttatacagttgttggggaataaattgtgcgctgaatgtcccgacgatgataccgggaacggccgcaatgatcatttgattgccaatcttgaaattgacatttttgattttcaactgtgttagaaaaccaaagaataaggctggtaaggcgacgattagggaggttggtacggctaccgcggttgcaaggcctacttcactggttaagacacctaggtatagggcagcacctccgccaccaatcagactaacgaagatgccgattagtaatccggataaaaagacaaacgtagtgaattcccccttagattgtataattataccttaaacggagtacactccgtttgtcaagtgatgcgtaaaagtgtatggtgaacttaagtaaataggagggtgtgtcgaatgcgaaaggatgcacaaattaaccaacagaaaattttgactgctgcgcgacaactctttgccgcgcgttcaatcgaaaccgttagtatgaaagatattgcgacggccgctggtatcggtcccggaacgttgtatcgtcactatgcccataaaagtacactatgtttggcattggtaacggaccgagtcgcaacttttattaaaaccaatcaagtctacttgaccacgacctcggtaggtgcagcggcacgttttgatcatgttattggggaatatttagcgattcgtgagcacaacatggcgttattaatgaatgtcgaggccggtgaacctggtcgccgtcaattttatcagagcgaactttatcaacaattatgtgacctattaacgcaactggttcgtgatttgaagccaacgctttcgaaaccggcatgtgagtttcaagctgatatgttaattgccatgctgaaggggactagttatgcttttcaacgtcaatggcgaggacggtcgcagcccggactattggcgcaattgcacgcgttaatggtgactgaatgatgttcactattggcactagtggtttggcgattaacagagtgggttgattgttaaatcaaaaaagatggttctaggcggttaatcctagagccatctttttgaatgagtcgtttaagcaggtgtcaccacgtatttttcataacgttgggcatcgacagtgttgagttcgactgttaattgggtgccatcagctaagtaatccgttttgagaatgttggcgtggtcattcaagtaagccactacttcaccatcattgaacgggattaataacgttgttgtcacgtaattcttaaagactttggctttgatcatactggtcaaagcttgtagtgaggcctcatcacgcgccgtatagatgagttgatcatcttgctggttcgggtagtcggcttcggttaaatcagctttattgaaggcataaatcataggaacatcgtgcacaccgatttctttgagcgtcttttcagtggtcgccatcatttccttgtaatggggatcggcgtagtcgatgacttgaatgagtaagtcagcattggcagcttcggctagcgttgaacggaaggcgttgatcaagttatgcggcaagtcgctgacaaacccgactgtatcactgagcagtaactgcttattgtcagggaaggttaactgacgaatacttgtatctaacgttgcgaaaagcatgtctttttcgaagacttgcttatcttcacccttaccgaacagtttcactaaaccattcatagtcgttgatttaccagcgttggtataaccgactaaagcgacgttggggagcccagctttatcgcgttgtgaacgtcgcactacttcgtctttattgagttccttaagttcgtgcttcgcgtgactgatccggtcttgaattgtccggcgatttaattccagttgcgtttcaccagcaccacggttggtaaagcccccgccaccaccagcagcggccccagcctgttggtcaaggcgattggagatactcgttcgtaatcggggaagttggtattgtaattgggcaatcttaacttgcaatttggcttccttgctccgcgcacggttaccaaaaatttctaagatcagaccagtacggtcgatgatctgaatgtccgtttgttcctctaagttacgcacctgactaggggtcagatccgcgttgatgaccataatgtgcaaatcgttggcggctgcgacttctttgatttcgacaactttacctttgccgaagaaggtggccgggttgggtttttccaatccttggtcaattcgcagggccgcgtgcatattattggctgcaacgagcgcttctagctcggacatggcgtagtcgtaattggcgaccgttttagacatgccggcaatgatgacttcttgtaatttttgagcgttggtttcagacatacactcactcctaacgtgttatgattgcattaagtataacatgtctaatcaaaatattacgacttcgggtattagggaggaatcaaaaatgggttacgtgcttgatttgcggcggcaagttggtcaccaaccgctagtagtggccggtgcggctttaatggcccaaaattcgattggcaaaattgtcttgatttatcgaaccgataaccactgttggggcttgccagctggatcgactgaaccgggagagacggtccagcaaacggcgcgacgggaattgaaagaagagactgggctgacggtgggtgagttaacgctgatcgatgtctatagtgggcccaagatgcactatcagtatcctaacggggacattattgacagtgtcaccacgttatatcgcgccaatacaacgggtggtgaattgattcaagccaccgatgagacgagtactgcggctttctttgctttagatgctttgccgacaccgttgaccccactgacaaagtggatgctttgcggtgagtaagcttgaccatgcagatgaggtttgctatagtggactgaaatattaagatgaattgtcaccggacaacgttaacccaacttccttaggtcattgtggaagttgggtggacgttgtcctttttattttgaggaggaattgataatgacgtggatttatttaattattgctggattatttgaagtggtatgggctacgatgatgaaattaagtaatgggttcagtcactttggctatgctgcggccacagtagttggcatggtcttgagttttggcttcttagcattagcaaccaaacacttaccgttgagtattgcatatccaatttggaccggtatcggtgcggtcggtgcgataattgttggcctggttttcttcaaagatacaattgcacccatcacgtggatcttcattgcaatgctggtcattggcattattggtatcaaagtcacgagttaggattgggggggtgttagtgggtttgtgattcatcagtgaagccccaacagcttttcaatatttttataaaagaatgaccacaagcatgaaagcggtgttataataactttagaaattaaatgaatatttgggttattcttagacttcttccgacctgagatagacgcactgttgccaagactttacaaaattttcttgttacacccggtcaacgcactacctctcggaggggtttcttaatttcgtcagtaattctgtgtatagtcttggttgagtacaacaaatagtgaaagaagtgacgtctgatgatgatgtatccgtatctgaatttaggccccagagatggcgtcttgataattgcagctgctattatgttagctttaacggtagtttttaattggtcagtctgggaacttttgtttgctgttgtggcagtcgtaattgcgttcttagcaggaagcatgaaaccgtctaagaagaacgtgcttgcttttttgaaaaaatagtttgaattggggtagcatacctgaattcttcaaacacgtctttaaccagcaaagtttaaggacatcattgataagatagccgagttggttctctgtcaattgatgttgcgaatagtgctacgggtgcttagtcaaacaatggcaagcacctttttcaattcgaattgttcaatagcccatgattaaaatacaaataaagatatctgtcgccagtaatcacgtatttagttaattaccaacaacagttatttcagagccaatataaaaacgctcgcgaccagtcagtggttgcgagcgttttgtttgatgagcaaaattataagtgttgattgactttcacgtcagctaagtcttgcgcataatcgacgacgcgaatttgatcgccattgatgtcgatgcgagtgacgctcccgtttttggggccgttcgtgatgtcgatttcaggagcaaaatgtgcgaccatactgcggattgtcgtgccgtgggtaaccacgaggactttttgatggtgatcgtggtgagctttcaagtagtcaaagccctggttgatccgttcccagtacatcgagttgtcttcagcttcatgccaagggtcgatttcacgcatcaggtcgcgagtctgatcgataggcacgtgttcaagaagttcgtgcatgctggtgaccccgtattggcggccaactagtgaccaagtccgacttgaatcgtcaccttcgaaataaccatagaaaacttcccgaaagttcatcagtgttttaaagggctgggcggtagcacccgccgcttgtcgaatgagctgagcggtgtcgattgcccgcttagaatcactgctgtagtagtagtcaaaagccgtgttcgctagtgcttgaccgaccttggttgcggtggcttgtccgtattcagttaacggcgagtcagaccagccttgcatgcgattatataagttgaaaaaagtctgtccgtgtcgaacaaagtaaattgaaaattgagccatgtgtttctccttatttagtcgagatggtctttgcggccaaagtagtctaacgtcacatcgttgtcgctaattgtgaatttcgtgacgctcccattttggggccgtgctggtgaggtcagtgcggcaaaacgagcagcaatactgtaaatcgtattgccgtggctgacgaccaaaactttgtccccgtcgtgatggtgagcacgtaacgtatcgagaccgccattgacccgttgccagaattcggcgttattttcggcgcgatggaacgggtcagcttctttacagaaatctttggctttttcgatgccgtattgttcaataattgcggacaaactaggtgcttgatggggcgcaccaaccatgaaccaggtctgcgacgtgtcatcaccttcaaaatagccataaaaggcttcacggaaggcggccattggttgaaccgtcaaatcggtattgccactggcaggaagaattaattctgcggtgcgcattgcccgcgtcatgtcactggcgtaaacggcatcgaaatcaataccgttgagcattttacctgcattgcgagcgtcctgttcgccgacagctgtgaggggggaatcacaccagccctgcattcggcggtacttgttaaagtaagtttgaccatgacgaatcatgtaaacggaaaaagttgccattatttactcctctacttggtgttcaaaactaagccataatgtgtttagtttaccataaaatgcactgcgattaattagcagttgctaaggcttgtcgaatctgagcggccgtttgcttattcccggtaaagattaagcggtcaccgtacataatcgtcgtatttccattgggcgcgatcagtttccgattacggatgacttgactaatggtaatatcctgggcaaactgtaagttcttaatttgaacatcagtatagagatggttgaggacccggacttcgtagatgctgttttcagtatcattgagcaatagcaaggttgacggtgattcaattaaggcgcgcagtaaagtaatgttggcctctggtgtattgtagacttcgacgcctagttctcggagttcatcttcatgttcgttgagcacattgcggtcttcaaaccgaacgatgatccgccgtacaccgtatgctttggcggctttagcaagctcgtagttacgttcggcatcaatatggccgagtaccaaaatatccgtgtcaaagacgccgtgatcctgtaagtcctgggctgtgaagttttccattaaggtcactggcacttgcgcgtggtaggtttgataattctcaggatgattcgtgtacattgacacgtcgtaccagccttttcgtagctgttgtgcaacgggtacggtgcttaagttagcgccgataaagtggaccgctgttttgaccaggtcttctttttcagctgaataaaacttgttaaaaatcaggggtgagatgacacaagtgagtagcgctgcgagtaagaaagcgccggactggtcactagtaattgtcttcattgacttggcaactcgaagaacggctaataccattgtcattgtcgttgcagtcagcgcggtaccggctaaagcattggcttgcttgaaccgtaactttaggacccagtagccgccaatcttggcaaccatgtatgctaagaaaaatagtggaattaatagtaaggttttgccacttgttaataaggtccgtaagttcaaatcgacgccagtcgtaatgaagaaaatcgggatgaagaagccgtaaccaatagcatccaagcgttcgcgggtcgtttcactagggttcaagagtttcaagacgattccggccacaaaagcgcccaggatgttttcagcaccgacggattcggccaccgtgaccatcgttacaatcaagaagaaggctaaccgaatatctagttgtgtcgtcgatttgttaatattttgatagaagcggaagaatggtttgaaccgtaagagtaatagtgcggcgacggctaaaatgagtaatagtaaccagagactttgtgagttactgccgtagacggatgcatagagcgtcagtcccatcatcggtacaagctcaccaaagaccgagataagcagaatcgtttgtccgaaagccttactaagcaattcctgttcttttaaagctgcaattacaataccaagtgaaatcgtgccaaataaaatcgcggcaagccagaaatcactgaagaggccgctgactttaaaagcagcggcgagtaacagcgatagaacaataattgtgctgtaggcgtacaccgaaagtcgaactggcgaatatttcggtgtgttgaccgcgtttttttgttctaaaggtgttaacgccgtgcgccgcttcttaaataggctaaagtcaatttcaagtccacttaagaacagcaggacgatgacgccaatcgttgagagttgtgagataaggtcagaggtgttcacaaagttaaacacgctggggccaattacgataccgacaatgatttccatgacggccgttggcaaactgttgattttgaatttagccatgataagcggaattaataatgcggctaataaaataatgactaaggaaacttgatccatgaataaatacctcgattcgttttagtacacacggagctgatcatcatcaaagccccagaaagcttcgctagcatgtgcatcggtgaaaactttcaggatttggtcgacaccaggggctaatttgtcaggcgtcagttggctcaatggttgccaactaatggccccctcgtatgagccggctagcaaatcaccgtgatagtgactagtggtgtataaggtaccaagcgacacgtcgccgtccgcattttcgacccacgttacggtgccaactaatttcaattgatcgacgtgcaagccggtttcttctaatacttcacgcttcatcgcggtgacttgtgattcaccgcgatcaacatggccgccaggaaaagttaaccccgaccactgtgcgtcaatcttattttcaaccaggacatcgccggtcgctggattggtgataaggcacatgttgacgagttctgcacggacggtccggtcgtggtgttcatgctgatccttagtggctaaccagtcttgggccttgtcattgatgcttgccatgaatgctgctttcgtttgtaggtaggctgcgagatcggcttgcccattgcgcgcacctttttcacgaatggcagtatacttgcggccgtctgtccggtgcgcattgagataatcccggaaagtgagcaattgctgataatgctgttcatcagttgtaatgatcacgtggatgtcgttagcagctaattgcgttgcgtaagtatgcgttgttccagcgaccggtcgtgcgtgtaacgtagctacggcagccgcctgatctttaacaagcaacgccaagtcaattgttggacgcgctaataattggggcatggccgtactacccacgtgactactttttaatagattcgcctgtaattgctggcgtaacaaggtttgatactcgattgcttgcttttgccagtcagattgataggcagttaattgaattggttgcatagaatccctccactcgaataagtcattgaaaggatacactttttgagtggttttgaaaaggaaagacatgcctttcaagaaattagaacgataatatttaagttgaacggcagttgacacacggctgagaaaacgctatcattgatttatacattaatagtaattaactgggattgtaatagcagtgttcaggagctacacaaaacccgcttagtcgacaggctaagtgggctttttttatgggaattttcaagttgaatggagatgagaatgatgcgaatcaaaaaggtgcttaataataatgcgtttataacccataatgatgatcatcaagaaatgattgttattggaaaagcaatcgcatatggaaaacatttcaatgataccgttgacgaaagtaaggtatacaaaatgtttacccccattagtcgaggtgatcggaagctgattttggacatggttaacgaaattccaatccagtattttcaaatcgctaaacagattgttgataaagcagagtctgatgaaaatatcgagctgacagatagtgtgtatattgcgctaactgatcatatttcgtctagtgttgatcgaattaaatctggtttaatgttgactaatcaattcttatgggaaattcgcagttattatccaaaagaatatcagattggacaatgggcgattcaactaatcaacggtacctgtgatgttaccctaccggatgatgaagctggattcattgcgattcatatcattagcggcgaattaggtgagcaattggatgaatttcatgaaattattaatttcattaagaagattacaagtattgtgacctatcaattatcagttgaaattgatcgcgattcgctcgattataatcgcttcgttacgcatttaaaattcttttggcaatacatgatggaaaatgataaaaagcacacgattggtgacctgagtgatgaaatgctggcaatcatcaaggggaaaaaggtagcggcttatgaatgtgcattaaaagtgaaagattttgttcagaagacctatcactatacgcttaacaatgaagatttactgtacatgacgattcatatcgcaagaattgcggatgcaaattagggggcagaataatgacatataaagaaatgaacgaccagattattaatggtgtcgggggtaaaagtaatattgagtcagttgtacactgtgcaacaaggctgagattcgtgctgaaggatgaggccaaggcagatgatgatttggtacggtcgattccaggaattttacaagttgtcaaaaaagcgggacagtaccaattagttatcggaaataatgttgaggatgtttataatgaactttctgatatgttacagctggatgaaaatgtagatcataatcagtctaaggataagcggagtattttcgacaaaataattagtacgattactggctcaattgcacctgcgattccattgcttgctggtgctgggatggggaaagtattgttgctcattctgacactgtctggattattaactgaaaaaagtcaaacttatcagatgttaaatttgatttttgatactggctatttctttatgccagcatttattggattttccgctgctaagatttttaagacaaaccaatttctaggggcatttatgggattggtcactgttaatccaaattgggttgcaatggtagcggctgggaagcctgttagtttcataggtgttcctatccaattggtttcttattcttcaaccttgattacagctattttatccgtatggttaatgtcttatattgaaaagtttgtaaagaagattacgccaggcatgattaaagtctttgcagagccgatgcttatcatgttgattactgcaccactgacttttattgttcttggaccaattgccaatttgatttcaatgggaattgcaagtataagcatgttcttgtatgataacgccggctttatcgcaattccgctacttgctgccgcatatccatggttagtttctattggtattcataaagcgctcagtccaattagtatccaattagttgcgacacagggatttgatccaataattcgggttgtggctttgtgttcgaacatgtcacaagctgccgcatcattagcagtcggtttgaaaaccaaaaataagcagttgagagccttagcactttcatccactgtgacagcatatcttggtggtattaccgaaccagccatgtttggtgtgaatctgaagttaaagaagccgatgtacggtgccatgattggtggggcagttgccggtttgtttgccggatttatgaaaatgaaagcatttatttatgtcactcctggactactcagcttaccaatgtgggtatctaagacagaaaactacgtcgtattggcagtcgctaccattgttattgctagtgtggcaacatttatcgcaacttggttgattggcttcgaagatcctgtcagcgaggaagttatgaaacaaaagcaggcgcaggcgaacaaagtggtgacgactaaacattcgattaatagccccgttgttggggaagctcggatgttgaatgaagttaatgatgaaacgtttgcaagtggcgttatgggcaaagggattgctgtcatcccaactgagggtgtcgtgattgcccccacggatggtgttgcatcagctgtctttgataccagccatgcgattggccttcatttagataatgatgctgatttgttgattcatgtgggaattgatactgttgaattaaaaggtcaatattttgaaacattagtaaaaaagggtgagcgctttcacgcaggtcaagagttattacggtttgatttagacaagataaaacaggctggatatgatccaacggttatgattattgtgttaaatacaaaggactttttagaggtcctaccagtaccagaatcgaacgaatctgtaaccgcagataataatttattaatgttagcgtaagtgaggtaggattgatggatgtttacaaaacgagtcctaactttatgtggggcgtagcaactgctgctaatcaagtagaaggcgcatggaacgaggacggtaaaggcatgtctattgcagattgcctgcgttatcggccgcaaattgatagtagtgactatcaagcggtgaaccaaatggatagtgctgaaattgaaaacgccttaaatgatgaatcgactaaaggttgggcaaaacggcatggtgtggatttttatcatcattatcgagaagatattaaacagttggcagagacaggaatcaatacctatcgattctcgataagttgggcccgtatttttccaaatggtgacgataagtgtcctaatcaagcggggttagacttctacctgtcactagttaaagaattggcaaagtaccaaattacaccagtggtgacgctatcccactacgaaatgccgttaaacttagtgctaaattatgatgcttggtatgatcgacgagtggcagacttttttgggcgttatgcgcgaaccgtcattgattatttacatgattatgtcaagtactggattccgattaatgaaattgacagtattattaggcacccattctcatcagctggattagtcgcagatcgttttgctagtcatgattttaaaacggttatttatcaagcaatgcatcatcagtttgtggcagcggcacaggttgtcaagtattgtcatcgtcactatccacagatgcaagttggtagcatgattactagaacgatggtttatccatataatagtgatcctaataatgtgcttgcagcaacgcaaacgatgcgtgaggtgtatgcatttagcgatattcaagtgcgtggagaataccctgaattcttgttaactaagctgaaaaaagcacatattacgattgaatttcaggagggtgatcaggaagtactacgtgagaatacggccgattttgtggcctttagttactactcctcaatttgcacggctagtaatgtggaaggcctgcgggtgaccaaggctaatcgaaccgttggcgtctataatcggtacttgcctgagagtgagtgggggtggcagattgatccagttggattgagactatctttaatcgatttgttcgatcgctaccaaaagccgttattcattgtcgaaaatggcctaggtgctgtggatgagttgagcagtgatcttcgtgttcatgacatatatcgaatcagttacttgcgccagcacattcggcagatgttaatagccattgcgaatgatggtgtggacttaatggggtactgtatgtggggaaccaccgatatgatatctgcgtcgtcaaaccaaatgtcaaagcggtatggtttaatctatgttgacttagatgataatggtgatggctcatataatcgatatttaaaggacagttatttctggtatcaagaattactaagctataagaatcaaattccagcaatttttttagatgaaaatagtatagtcgttcaatgagcctaataaaaaaagggcgcaatttaatttgcggcctttttttactaattctatttataagaaatccgctgttgtcgccaggtcttaatcagcgcaaccactgtggctggaatgagcgcggcggccataattcctagaaaacagagcgagaggtggttctgtacgaagctgatcgagccaaagaagtaaccaagtgaacagccgacactgacccagataccaacgccaactaagttccagatagcgaaggtcggttgcggcattttagcggccccggcactcagcgggacaaaggtccgcacgagtggaacaaagcggccaaacatgacagctttcgcgccatacttagcaaaaaattgttgtgcgcgttgttgcttggattgggggaggtggcgttgcaaccacggtaagcgaatcaggtggcggccaatttcgaaattgacagtgtcgccaattacagcagccacaaagaatactggcaccagaatctgaatactgagggcgtcgctgtgagttgcagccatcgtgctggcgagaaagatcaatgattcgccgggaagaaatgggaaaacgaccatgcccgtttcaagaaagataacggcgaataataagatgtaagaccaactaccaagcgtggttaatagtgggacgatactttgtcctaaatgggttaaaatggttattaaattgaccaacggcgccacctccaatttaagttgcatttattataagcgtctgcgggttgaaaaacagatgtaaccgattacatttctttcagtttaacataatcgtaactttgatagaccaatgttcaaacaaatttacataaaaatcaaaaactggcggctgccatgggttattaattgagtcgggccgccgatagtgataaaattattgttcgatatttaggaatggagggcgttcaatggctaagtcaattaaagctgcagaacaggaacacttagatcatgtggttgcgaaaattaaggtggctgaagaacaacaaagccaaaccattacgcgctcggaaaaagatcaggccgatattaaacgtgacttgctgaataacatcaatattaaaacggatagttacgaaggcatgatggagaccggattatccgtgcggcagcaacaacagatgatggatgagcggcagaatagttggaagcacgcgactaagcaattatcgacgttaaaaaagttggaaaagaatgcttattttgcgcggatcgattttcatgagactggtgagcctaagcctgagacgatttatatcggactcagttcattttctgacacgccggatcactttttgatctacgactggcgagcgcctatttccagtatttattatgacggtgggttagggcacgtgacgtaccagactccggatggtgagcagaccgttaatgtgaagttgaagcggcagttgatggttgagaatggccagatcgtgacagtctacgacactgatgaagccgttggtgactcgatgctactagaagtgttggatgaaaagtccgatgtgaagatgaagagtatcgtgacgacgattcaaaaggaacaaaataccattattcgggatacgagttctgacctcctgtttgtgcagggggcggccggttccgggaagacctcgtccgttttacaacgggtcgcatacttgttgtatcgttaccggggtaatttgacggccggacaagtcatcttgttctcaccaaatcaactctttaatgattatattaaccaagtattgcccgaactgggtgaacaaaacatggttcagatgacctatttccaatacgcatcgtaccggttaccacacatgcaagttgaaactttacagcagcggtttgaaactgaaaatacaccgcagatggcaaagattacgaagttggaaggtagcctcgcattcttcaacgcggttaccacgtatggccgacatttggaacaagcggacatgcgtttccgtaacattacgttgaacgatgaagtgattatttcccgggaaaagattaaatcgatttactactctttcaacgaaaactaccacttagcgaaccggttatcagcaactaaggaagaattaatcaagattttgaatcgcaaggttgaatcggagatgcgttccaagtgggtcgaagaagcggttcaagacttatcacgcgaagagatcaatcaattatatggcaatcagccgcgggaatttaagaatggcgataaagagtttaaattcttagcacgtaaaattgtgatgcaacgcttagggaaagcccggacgcaaatcgtgcgtaaccgtttcttgagcatcaacatgcagtacgcgcatttcttacgcgaagtaccgaagatcatcaagttggctgatcacggtatctcagctgctgactgggatgctacggttgaacggaagttggctgaaattaaggaccggcatatttctttaacgaccgtttcggcctatatgtatctgcatgatttgatgacggggaaacatggacaacgcgacattcggtttgtctttctggatgagattcaagattacaacgcctttcagctagcgttcctgaagtttagcttccctcaagcccgcttcacaatgctcggtgacttgaaccaggcgatttttaccaaggaaaacagccattcgctgatcaatgaattggccacgttatttgaccctgaaaagacgcgggtcgtgcaattgactaaatcgtaccggtcaacacaacagattactgatttcaccaaggaaattttagtcaatggtgaagccgtcacggcttttgatcgtcagggcgacttgccaaatgtcgttgtgacgcctaactttgaagcaggggttgatcaagtcgttgatcagctagcgatgaacgattctgaacgtgatacgacggcaattatcgggaaatccttagcagaatgcgaggcgctcacgaaggccctgaaagctcgtggtgagcaggtcacgttgattcaaactgaaaatcaacgcttggctcctggtgtcattgtagtcccgtctttcttagcaaaagggttggagtttgacgcggtcatcgtgtggaacgctaatcaggaaaattaccaacgtgaagatgaacggcaactattatatacaatctgttcacgggccatgcacgagttaacgttagtcgcggtgggtagcttgtcaccgttactagcgcgggtgaaccacgccttgtatacattaaatgaagcaaaagtttaagtcagtttaagacagtgagtaccgctccattcacctggagtggtatttttttagttttacttgtgaaggaaatcttaaggtgtgtcaggatgatcagtggtggaacagttggggaattgtgtcggaatagctgagaaaacgctatcatagtgatggaataagcgttaaaattaactcatcaagtgcagtagtcggtgagagacaatggccttaatactgactaggcacacaatatcgtgaaaatactaacaactagttagaacggttgttagtgacctgaggaggaaacgacgatgtcaatcactgaaatgttaggtattcaatatcccattttttctggtgccatgatgcgaattgcgacccatgaattagtcggggcggtttcggaagccgggggactcggtgttttaggttcagcggggttatctgccgaacagttgcgagcagagatccaagcaacccgcaagctgacggataagccgtttggtgtcaatttaatgttacagatgaagaactgtccagaactggcccaagtcatcattgatgagggggtcaaggtcgtgacgactggtgcgggtaacccgacttcatatattccgccgctacacgcggccggtattaaagtgattccagtgattgcttcggtccaccatgcccataagatggtggcggccggtgcggatgcggtggttgctgaaggtcaagaatcaggcggacatatcggtcaaacgtcaacgatggcattattacctcaagtcgtggacgctgttgatattccggtgattggtgctggcggtgtcggtgatggccgctcgattgcggcgatgtttgcgctgggcgcccagggtgtgcagtgcggtacgatctttctgacagctgaggagtgcccagttccagctagttataagcaacgggtattggctgccagtgacacggatacaatcgtgactggccgcagccagcgcgatccggtacgggcgctagttaacccgatgttggcacaatacttgcaattggagcaaactaacgcgccggtagcggaattacacgcgttagcggacggttcatttgcgaaagccgttgaagatggcgatatggaacatggtacgcctatggccggtgaagtggcggggatgatgacgacaattcggccagtcaaggaaattattacgacgttgtttggtcaggctcgtgaggtcgcggcacaactgaaaatcgaataagatacagtagcatagctcggtactaggtcagcgttaactagtatcgagctattaatggttattggctaccaattaggaatccggttaatttgaattttaatcagcgtttgataagggtttcatgttataatcaacccattaatttagtaatggtggcagacagaaatcatggaagatcagatgaactattatcgcttctcacgtgaacagtggaagcaattttatcgtaacaatcagcatcaagtaccattgaccgcagccaatttgcacgaaattgaggcgtttaatgaccggattagtctcgacgatgtccgtgatatttatatgccgtttgcgcatttgttgcaggccaagtatgaacactacttgtcatggcgggaaacggagtccgtttttttacaccgtcagaaccgccaatccccctttattattggagtgtccggaagtgtggcagttggcaagaccaccacagcacggttgttagagattctatttaaatatttatatccagaccggcggacgcaattgattacgacggatggtttcttatacccgaatgccgagctcaaaaagatgcaattgatggaacgtaaagggtttccggaaagctatgatatgacgcggctgatccaattcttgaacgatgtgaagagcggaaagccattagcgaaggccccggtatactctcatcagacttatgatattgtgccaaaccgctttgacgtgatcacgcatcctgacattttgattattgaaggaatcaacgtgttgcaattgccaagcaatcaggcgatctacattagtgattttacggacttctcagtgtatgtggatgcggatgccgatttaattgaagattggtacttagaacgcttcaaggccctgatgaaaacggctttccaggatccgacgaattatttctatccttgggcgatcggtgatccgaaggacgcaatggcgatggccgagcgtgtttgggaagaggttaacttgaaaaacttgaatgattatatcttgccaacccgtaatcgtgcggatttaattttgcacaaagttgcgcatcatgtgattgatgccgtgtatttccgcaaatattagcacctaagaaatttctcatactggttgaccgaacgtttagaaatcagtatgatagacctattgagcattaattaatccaaaggagtgaacaacttggcaaaaacggataccgcgtctttcgattccattttggtattggatttcggtagtcagtataatcaattgattacccggcgcattcgtgatttcggcgtttattcggaactacttccgaacacgatcaccgctgaagaaatcaaggcccgtcacccgaaaggtattatcttttctggtggccccaacagtgtttacgatgatggcgcctttcgggttgacccggagattttcaagttgggcttaccaatcttggggatttgttacggcatgcaactgatgacctacacgcttgcgggcgggaaggtcgaatcagctgataaccgtgaatacggtaaggcgaacattgacgtgacgagtgactcggcgaccctatttaaggacacgccagctgaacagtcagtgtggatgagtcatggtgacttggttactcaagcacctgatggttttgacgtggtggccacttctaagaactgcccgattgcagcaattcaagatgttgaccggaagttatatgggattcaattccatgctgaagttcggaatacggactacggtaatgatattctacggcactttgcatttgacgtttgccaagctgaagctaactggtcaatggatgatttcattgatatgcagattgaaaagatccgcgctgaagttggcgacaaaaaggtcttactgggactttccggtggggttgattccagtgtcgtcggtgtgttattgcacaaggccattggcacgcaattaaccagtattttcgttgaccatggtttgttacggaagggcgaagctgatcaagttatggcgagcctagaaggtaagttcggcttgaacatcatcaaagttgatgctaaggaccgcttcttaagcaagttggctggtgtcagtgatcctgaacggaaacgtaagattattggtaacgaatttatccaagtgtttgatgaagaagccacgaagttaaacgggatggaattcctcgcacaagggaccctctacaccgatgtgattgaaagtgggacttcaacggcccaaacaatcaagtcacatcataatgttggtggtttgccagaagacatgcagttcaagttgattgaaccgctacggacgttatttaaggacgaagcacgggaactcggtgaaaagctagggatgccgtctgaccttgtttggcgtcaaccattccccggccctggtctcggaattcgggttattggtgagattacggaagataagttagaaatcgtgcgcgatagtgactttatcttacgtgatgaaatcaaaaaagccggcttggaccgtgaaatctggcaatacttcaccgtattaccaggcatcaagtcagtcggtgtcatgggtgacggccggacctacgattacaccgttggtattcgggccgtgacatcaatcgacggtatgaccgccgactttgcacgtattccatgggatgtcttacaaaagatttcagtgcggatcgtcaatgaagtcgatcacgttaaccgcatcgtgtacgatgttacgagtaagccaccttcgacaattgaatgggaatagaatttattgaaattaaacgacttctatcccattagaacgagattcgtaaggatttcaaagttgaacaaagctgataaatttaaagaaaatcactaaaaaagtggtaccgaaatggtaccacttttttatttggaatagcatatggtacaaaataaaaaatcgtattgaaagctatcaaagataaaagatactccgtttacgagagcatatgttagggcagtcggacaaatatcaatatcagtgtgtactggtttaactagtcgatttctatcgttaacacatgcgttcttttagggctgatattactaactgattgtaaattagactatgcttgtggttgactaaaatgctttaatgaagctaaatataaagatccaccaataattgcgagaattccgccaatccaacccaagaatggaataagcgcgattgcgccgccgacaattagtaaaacgcctgatgcagtaccgacacgcttatcacctttataataaattaatgcaataattcctaatgctaaaatagcaattttcaaaatgtttaggaaagcggccgcacctgatgtattagatactgatccagtggcagcatcgctaacaatgccaccagcaataaaccagcccccgaataataaaataatgccgccgactagccctacaatcccgttagtaagtgctaaattttttgacttcatgttgaagctcctccctttattaacagcttttcgtgtcgatcagtttattggacataagttgttgaagcctacccaaaccattaatccccgtattgataggcttatttttcgtataaataaacaaaggtgaccaatattctggccgataaataagctttccataagcgtgcccgaagtaacttggttcgaacattaagatacttcatcgtaaggggcgttagtcgcgtttagccctattcccagaagatgacggccattgctactcgtacttgttggcgttcttcttccgtaagtgcttcgcctccgtatgtcatcgaatccacatgagctgtgagaaagtcttttaagtcagtggtatcttttctaacaatccatttagatgcgctatcttcacccagcaggtagtcggttgtcacatcatatagatctgcaatctgtttaagcatgttcaaatctggctcattcgtgccatattcatagttggcatatcgctgcatactgctcaaccctaatttcctggccacctcagttttcgaccagttccgactgtcacgaaggttaattagtcttcgaatgaagttgttttgtgtttttgctggcatgttatagtctcccaatgaacgtattgtataatatttaaacgtaaaatttatatttttaaataaaaaatttaagaaataacttatttaaataaactatttaatataaaacatgatttatcgatataaattaattgcttgttaattataatgcattcagtttgttagagcgaattcgtggttaaacgtaaaggttgctaagtgtttgtattttcttaacattgaatgacaactaatttggaggtgcaataatctagcgttctgttttttgttgaatgactaactaaaaattggtaggttgattgttagcttaggttgtcaggataagcgaaagaactgtacaatgaatgtaattaaatttagagaagggggagcaacgggtgaaattatttcaaaccaagcatattactgtaagcattgccaaaacaagccatcaggagaagctggaaggtctggttttctggggattattattgttcctagtgatttggcgaagaaagcggtaggcgtatcgttatgaatttatggaggattttagggtgaagaataagcaagctaatcagattttaagagcttgggatttagctgaaaaaattagtggtggtgagcttgacaagaaggctaaatggtttagtggagacatacgaaaaacagcgtatcagaagcgtgaattaggtacaataaatgaaaaaatatctcaaaataatcaatcaagtgatcaacatgtgacgatttcacttttgtacttaggtgcatataaaaaacaagatttacgagatagcattcaaaatattcgttttagagatacggaaatggttcaaaatcgtgatcctgctaagggctatagtgtggcattaatcgttaatagcgactggtcctttcaaaagattgaggtaccttatgcagcttatttttatttgaagcttcggcaagaaaatatcgaggaagcgatgcatggtcaacaatatgatgacttcaagagccaattgtcgcaacaactagaagaagttattgatcgaaaacgagccgacttagctgagtgtttggcactggctaaccagattgtactgaagacttttaagttagcaggtacacgtaacgtcggtcagttgcggggactctttcaaatccaagatgaacccccgatgttaaatagtttctatactgaggatattgagcgtgtattgcaggcgtctgcggacgattcattactattgaagtatttaggtttaaatcctgatgttgcgacaaagcaagaagtggatcagaatcgagattttatttcaaaattattggatgtagaaaatctaccagatgggcggtggcctggacctgaaaagtactttcagtcattgatgcagcaggtggcagtcaatgtgattcgtgacaagggaccaattaagactgatctaaaaacagtgaatggaccaccggggaccggaaaaacaacgctattacaagacgtgtttgccgatacgatcgtacaacaagctaaagtaatggcacaattggaaaagccaatggatggctttcggagaattaaacccattgagttgttttctaactgtaagtataatgcctatgaattaattcctgccctacaagggtacggtattgtggtgacgagcaataataattctgcggttgccaatatttcaaaggaatttccgagtcgtaacaaaatcagacagtatcctaacgagaatcgtgagaaacaagatgagtatcggactcagctagaagaaattgactactttagcgatttagcgaatcgcattttggagacagcggactcttggggaatgtttgcggttccgatggggagtaaggccaatcagcaaaaggtatttaaacatattaatcatggcgtattaaagaaacagttaagtgtatactcggatagttgggcggatgcacgacagaattttaatacggcattggaggcagttcatcaggaaaaagcgcgattacatcgaatgatttcaatcgttgagcgggccaatccatccgtagttgatcaggcttaccttgagttgaaagttgtagacgaggggattgaggtactaaatcaagaaatcgctaacttgacacaaaaaattgagaatacaaggcatagattagtaacattaccgaaaaaaagatttttgattttctggcaacacgaaacgccaacacatgatagtctaagatttcatatttctaatttgaataaaaaaattgaaggactcaatgaacgagtagcagatcggcgaaaagaacgccggcatgttgttcatttaattgcacagcaggaaaaaatcattcgtgaagttgaaccaatccaaaaacaattgaaaaaagagggaatcgttgtttttaatgatgacttctggagacagacgaatgagaaacgccaacaggctttgccgaacaatagtagggttctccagaacaagcgtgcaagattattcattgctgcaatgcggctacggaaggtatttatttgtgaggcacgtgttccaatctcgaacgcttgggagtttttcgcgcatcagaataagctagtctttgctgaagatactttggccctaactgctggttttcaaattatgcaactgttgattccggttatgagtacgacgttggccagtgttggacggatgtttgccaattttggtgagaacactatcgataatgtttatattgatgagtctggtcaagcgacgccggcttctgcggttggtatcgcgtggcgtgcaaaacatctagtcgcgattggcgatcctgcgcaaattgaatcggttgtgacgactaatgaggcgacgttaagaacgattgcgcgtgatttcaaagtatcagaacaatatttgctgccgacgacgtctgtgcagcaacttgcggatcaaggtagtatttatggtatgcataggtccaatcatacatgggtcggaataccgttatgggttcatcgtcactgtgattcaccgatgtttgaaattgcaaatgaaatttcttatgagaataagatggttcagggaaagccgacgaagctgtctcaggttgaacgtagtcgctggattaactcaaaaggaaaagcaacgaatcaacaattcgtccctgaaaatgtgactgctttggcacgaataatgaaaaagcggcgtgatgaaggcaaaagtttggatcaaatgtttgttatttcccccttccgtgcagtggtcaacggtattactaacaagttgccaaaagaatttaatgacggtgcgatttctaagaaatggttgcaagaacatgttggcactgttcacagatttcaaggtaaagaagccgatgttgttttcctaattattggaactgaccaagatactgacggtggcgctgactgggcatttagtaaacctaatttattgaatgtggcagtgacgcgtgctagacatgatttttatttgattggtgattaccatcggctcaagagtaagccttatgctgaggtagccgctcgtgagttgccattattggataattaagaagttattgattgttactttttaagttgtatagaacagaactcacactaaaaagttgggacaattagcttacttattcggtagctaatctgaacagtgtattgttgtagttcgtattcatgtaggtcgtcaaatttctctagatagggaatggttctaggtgatagttggggtgtgtttgatatatcattaataatgaattattgctgttaaggtcggaaggaaaaaatattcggcacgttaaaatgacatcaatagaagatgctccaatacactttaaaatatagagaagaggcttaatatgtcaaaatcgcattcaactaatcgaacggtcacctggctcctcaatatcgttaaactaattggtctattcgcactatatcaactagctatgattccaacgatgatgccagcaattcgacatgggttctcggccacggcaacactaattgccggagtggcaagtttagtcttgctcggatcactcatttggtggctggtaacgatttatcgtcgtcaagcgccaatcgtgaccagtttatcacgaccgacacgtccggtgttaacgatagtgggcctatttatcctggttgagttaggtaacgtgttggcgggacttatcgtgaaacaaacccctgaaaaccaagtgattttggataaggtatttactactagtccagtcattaatgttgtcatgatggcagtattggcaccgattgtcgaagaactgattttccgcgggctgatgtatcgttggttatttccgcgggtcacaaattgggtgagtttcacggttgcattagtttttgcgagtttagtatttgcccttgcccatacgttatcgtttagccctgcgctactagcctatttaccgatcgccgtcgtgcttacttttacgtacgtgtggttcaacgatattcgctatagtatcgccttgcacattatcaataattcattagccatggttggcatgttgaccttgctttcacgttaacacaggttatcctaccgacatagcggttgacattcgcgtattagtcgcgtgatgtgtaatgattaaaacaggcaacgtccaaattttgggcgctgcctattttggtagggctgagttaataatagataggaattggtcatggtaacgtcattaataatgtttgattagcaattgttgattatcaaaataactttatactgtaaaattggaacaatggtacttcctgatttgcgacttattcaacgactaaaattcataatagtcctgattaaataaggctttccaatgttcaatcaggacataagggtgtaaacaccacctagtattatggcatcattggtttataatgatatttatattaacttattggagtgagtttatgaataagaaattattatataccagtattaccactgcggcattattcgtggggacccaactgggtgttaacaatgcgcaggccgacacggcaactgataacagcgatacgacgaatcagacgagtgccacgcaggggagcgctcagacggcaactaacgaaaagttagcaacggtcaaaccgactagtcagcaacagtatcaagccaacgtgcagactgccaaggggaacgtagccacggctcaaaaccaagtcaatacaacacaaactaaagtggcgactgcgcaggggcaagtgactaatcaaagtcaattagttgcgattggacagtcccagtatgatgctggtaaagcccaagttgaccgtgcacaacaaacactggatgctaacaatcaggtcctcgctgaggctgagaataaagtcgacgctgctaagtcgcaaatggcagcagctgaaacgcaaattccagctgatcaacagcaaattgcggccaacaaagtcgctatcgccaaccagccagctaccaagaagaaagcacaaacggctaaggacgcggctgacacggccttgacgcaagctaaaactgaacaggccacggcccaatctgatgccgatgcagccagtgccgtcactgccgctaaacaggcgacggttgaccaagcatctgccgcccagcaaaaagcggccacccaagcaaatcaagctaaagtggccgtagcatcagcgcaagatgcggttaataaaaatacccaggcaatcaattctgccaagacagcgattcaaaatacgaccagtcaaattaatgcgaataatcaagctgtttccacagcgcaagccaaagtgaccgcagctcaagcagctttagcggcagcagaacggccaacgaccacgacggaatcgcaaaataagtatgacgctgccgaattcccacaatctcaattgactggggccgaaacagtcagcgtcgcctatccaagtaatggcaagtatgtgcctaatgcggataaaatcaatcagtatatgtttgaatatatcaatcagctacgggcgctgaatggtcaaccagcattgaaacagacggcgacgttgcaaaataatgcgattgcgcgagcagctgcccaagacgacggtggcttggatcatactggctcaagttatgcagaaaatttaacacaagtttatccgcaatggttcatgagcgatcaagaaacggcctataatgctgtgatgggttggtatgatgaatccaataacattgaatccggttcctttggtcaccgcgtcaacctaatatactcgactggtgatgccggagtagccatcaacttggccaaacacgtggcggcatttgaagtcgataatgccgggatgacggaagcacagcaagacaagtatgttgatttgttcgacaatgcccatgcgaatgccgctactgggactaaggccttaccagctgtcacgttcaattacgtccagacggcccccgctgatccgaagaagattgcggcggctaacgcaacgttgattgctgcaacggctagtttgaatggtttacaaaataccgggaagacattagcaaccacgctggctaaccaaaatgccagtttacaagctttacaaaaccagacaagtggcttacaaacgactgttacgactaaacaggcccaagttcaagtcgctgcaactagtttgacagcggctaatgttgctttgacgcaagctcaagggcaattagcaatggcgcaacagcaacaactatcgcccgttcgtaatttgaagacagcaatcgcgaagacggctgcggcgcaagtaactaccacgcaagccgctaaaaacttagccagtgccaagacattggtagccgatttgaccgctgaaaacgcccgattggcggccgaaatcgcggccctgcccgcgcggattgcaagcatgaaggcccaaattgctacggctgaacaacaaatcgctgttgccaaggccatgctcgcgcaggggcaggctcaagtcgatacagcaaacgatcggcttgctgccgggaaagcgcagctagatcgtaaaaaggccgatttagcacaacttaaacaagtgcttggcgctgccagagttgatttcgccgtcgcacaaggagatttaacggctgctaaagccttcttggcacgcgtcgaagctaacaaatttacaacgacgacggctgtggctgatggaattgttgaaaccacaagtgttgctcaatcggctggtgttactgcaccacatgcaaccgcgactgaaaccgtagcgaatagcaaagataccgctaatgccacgagtactagcgcagatgtttcagatggcaatgcaacaacgaagctggttgcgggcgccaaacaacagccagctgccgcaaaggccacggcgttaccacaaacggatgaaaaatagtcagcgagtttgactgtggtgggattactagcggcagggttctcattattgggtttaacaaagttacgcaaacgcgcttaatttctgagctcaaagctttttagaattattgatcatatgaaataataaaaacacttggactaggatagccgatggataccgggaatgatagataggcaatgaatgcttacctatggttgtcaatcagccgaaatccttggcctgactgtttttttagtggttagatattaagtttagtgaattaaacataaccggtattaacaataaaagacaactcatttttgatattttgtacacggcaaggctaatatttagtaatatattaagtaatacggccattgaagtttttttgattatttaaataaacgaattaaattaatggataattaacggaatgaaaaatgatccgttattaaatgcagagttgcaattgacagccatggtacataatgtgtccgtataatcccgtggatgattgggaaatccagggtggctaactgccgattgctttaaggggaattaaggttgtgaaaggaatagaggtatgggaaaaatcagtagcagaatggtctttgaaattatcacgattatcggtattgtcacttttgccgttatcagtctaacaccatcaacggcgaagcagcaaagtgtgcaattggatcacggacggatgagctatagcggggccgttttgaagcacaagtttgacggtcagggtacgttgcaggttaacaaacaggggcgctacgtgggtaattttaccaatggccggtttgaaggcccaggcgaattcattgcaccgaacgggtggcgtttgcaaggcaacttcagcaagggtgcgttgaatggtgtggtcaaactgcgggtcggcaacaagacttatgccaaaaaaattacgggggacggtaagttagaaaatgcggattaaatggtttagtttagtacggataacgggactcgtgctggtattgacgtatcactttttccaaacccagtttactggtggctttatcggggtggacatcttctttaccttctcagggtttttgattacgtcattaatggtggacgagtttgctcgttcggataactttaaactaatggctttctatggtcgccggttttatcgaattgtgccaccattatttattgcggtgttattggtgctaccgctaacttacttgattgaccacgattttgtgaccgacattggtaagcaggtcgcggcggctctcggatttacgactaattattttgaaattgcgacgggtggcagttatgaaaacaaatttattccgcacttatttgtccatacgtggtcattagcggttgaaatgcacttttatattttatggggcctgattgcgtggttggtcgctaaaattagtcggcggttggcgagtggtcggcgcgcattgacccgttttcgctggggcttagggctgttgaccactgcctttgcgattgaaagctttgtcatgatgtactttggcgcggtcggcttaaaggacttttcaccagtctacttttcaagtctgacccactgttttccgttctttgtcggcgggcttatcggtgtcctgagcggcatcaaagctcaagggccaatctatcgttggaccacggcgcactgcaatccgatcattgcgggcgcagtgatgcttattagttttatcttgttagttgctttaggcgaccggatgaagttcgatgcgctacaaacgtatcagggtgggctgttactggctactgtactcgctggcatcatgatctatggcgcccggttgttgcatgaccacacgccgaacctcaaggaaccgcggtggatgacattcttagcggatgtgagctatagcgtgtatctctatcactggccgttgtacgtgattttttcacacatgatggtcaactggttggcggcgctgctcacgacggtactgtcgattatcctatccgcgttgtcatactacgtgttagaaccagtgattgcgggcaaacgcgcccacattttcggtcatacagtgacgtggcggcagttgcagttacccgttatcaccgcaggagtgttgttggcagttaataccggggtcgtggtcaaaaatgccccgcaactttcgacgctggaacagaatttatgggtgagcgggatttaccaagatattgataaaatcggaacgactcatgaagctgtgctcgcggccgtgacgcccaagaagaagcaggcaacgcctaaaggtgaccaagaaaaggcaccaggcgtttccattattggtgacagtgtcacgctggggacgcggagctacctgggtgatcacgtcgcgaacagcaatattgatgcggagggcgatcggacgatgaacctggcgtataaagtcatgatgaaccagcagcgaagccatacgttacggcaatacgtggtgatttgtattgggaccaacgcgctggatgattacgaagaacaaaccatgaagatcattcatgacttggagccggggcacaagttgattctgatgacaccttataatgcccgggccgatgctgactggaattcatcaaagttggccgttttggaacggcgtctgccagctaagtataagttcattacggttgccgactggggcaagattgcggcgcaacatccagaagttttcaaagggacggatggcgtacacttcggtggcattcgggctggtgatattttgtacgccaaggtaatcaatcaagcattgacggcagccaaacggactccggctaaaccagcctaatctagctaagtcagagcagttattattagtcaatttaatagaaataatcagcttgcgatgtaacaattggcaggctgatttttttatgtttgtggttaaattgcgaagcggcgggattcattgatgttaattgttcagattttaagtgacaattcgaccagtgtgcatattaattgttctaaaattaaattatggttatcataagcatgtactcaaatataactgtaaggagtgattagaatgttaggatggctatggtcattaattgttggtggtgtcattggtgcgttagcaggtgcgattaccagccgtgacgttccaatggggatcattggcaatattattgccggtttagttggtgcctggattggtcaagcattgcttggaacttggggaccttcgttagctggtatggcattggtaccctcaatcttaggcgctattatcttagtattaatcgtttctgcaatcttcggcatgcgtaagaaacgttaggcggtgattagatgagccgcttagctaagtttacggtgacgttagtcggaattgtattggtgttattagcggtttttgaactgggtcagttgtacccgatcccgtggttgacgtcctggttagctgatctgacgattaactacccaatggtttggagtatcttattgatggtctttgccattattgccggaatcgttggtatcttattggtaattgtcggcttgtttcgaccagttaaagtcagcacgttgacgtatgatggcaaggttggccagttaacgattccgcaaagggctttggaacgtgatttgcagtaccgactcgttaatcagttgaatctgattgatcctgaggttcacttgaaattacggcgtcgtcgccgggtacgagtaaaaattgatgcgatggttaatactgacgcatcgttagaaaccacggcccaacaggcggcaaccttggcacaagactatttgaagaatcaattgggattgacggtcgaacaaccagtagtgcaagttaagccagcaaatcaccagcgtaagttaaccgtggtgtaaaggagggtcctgatgagtaacgcacagtatggttttctgattggactgcttttaggtatcgtctgggtattaaccagtttttcggcagtcttattagtcgcagttttagggctgatcggctgggcgattggacggtttgtccacgtcgatttggctgtagttagtcagaagttgagtgagtatttatctaaataatgggaggaattacaatggcacaaccagaacaacaattacagactcaattgacgtttgatgacggtgtgattgaaaaaatcgccggtctagcttcacgcaatgttgacggcgtgttatccctagaaggcggcatgttaagcaatttaacgaaccgctttcgtgatgaagctgacccgacgcagggggttgacgcccaagttggtaagaaacaagttgctttagatatgacgatgatcgttgaatatggtaaggacatgcgacaaatcttcaatcaaatttgtcaacgtgttcagcaagatgttgaacggtatactggcttgaaggtcattgaaattaaggtacatgtcagtgacgtcatgagtaagcgtgattggcaagatcaggccactggcaaaccaaatacggatcaatcaacagataaacggcaagttgaatagcatggtcgtttagagtagtcattggtaagacgatttttgacaaaacaaggaggaattttgatggaagcaacagcgacatctttaaaaccagaagttgtttttgacgatacggtattggcaaagattgctagtaacacggcccaagaagttgaaggggtattgagcttacagggaaatctgattgatgatatttccaatcgttttacggataaggatcgcccgcagaccggcgtttcagtggataccgatgacgatgaccagacggttggaatcgaattgacggccattctagcttatggtaagaatggtcaggagattctagcacgggtggcggataaggttgccaaggccgttaaatcaatgactggttatcaagtgactaagttaaaattagtcgttaaagacatgttaacgacagaagagtggcggcaacaaaatgacaagcaagaaaaagcaccagaaaagaaacacccagaaccaaaggatgacggcccacattaatggcagccgtaatggttaaaggtactcgcaaattaggcgggtaccttttttagtgatgagcgttacatgaagaaatatcctgagctaagttcgtaattgcgtttgaatgttcatgaagattgtccggaatgaccgtcacgcaactatcattattgttaggattcatgagatgagtgtacaataatatcaatgaggtgattaatatgaaaattggcatgcgggccaaccgaccgtttatcattacggatgaacagcatggacaaatagttttaaatgcgaagacagttttggaagcgctacatatgccagcagcggaccggcaacttagctcgcttgaaacgtttgcgccgcaagaattagcggcaccaatcacggccccgcgacagatttttgcggtggggatgaactaccgcgaccattcggcggagatccacattacgctgccgaaggttccaagtatttttacgaagtttagtagttcactggcaccagcgaacgtgaccgtggcgacgcatggtcctgagaccgactgggaaaccgagctagtcgtgatgattggcaagggtgggcgcgatatcgcgacggctgatgcaatggcgcacgtggccggagtgatggttggtgaagacttatctgatcgagccgttcagttcgagaatgataatccacagttttcaataggtaaatcgtttgaaaattacgcaccagttgggccgtggttaacgaccgtcgatgagttagctaacttagacgatgaggtgatcacgaccaccgtcaatggtcagacgatgcagcaagcgccgttgagccaactgatcttcaaggtaccggatttggtgcactacttgtcgacggtctgtgagttacaaccaggtgatttgatttttaccgggacgcctagtgggaccggcgttggtcgcaatccccaagtctttttgcaagccggcgatcaactgtgcggtcagattacacatttagggacgttaaatatcacgattaagtaaatagccatagtcggtaagtgagatgggtgaagatttatattgtaacgcccagcacaatgccgactttttttggtaccataaaagtaattattgaatagggggataccggtacgggaccggtgaggagcaacatgaaaaaagtgtgggtcggattattattaggaagtttattattagcgggatgcacgacgtcgcccaagtcgtcagcgcccaagacgagtcaaaaagcaacgtcaaccaaggtagcggcaaagcaggctgctagccaaaaaagtaccgctagcagtgattcttcatcaccggctgaggcaaccttgtggaatacgggcaagcaagcggctttatcaacgtttatggccgcttggcaacgcgagatgggccagacctatgtcgggacgtatgatgacaaggttcctgaccatttaggttttcgttttcccaatgctttgcttaatggtagcttagcaggccgaatcaagtggggctcgcagtcagtggatctcaagtggtccaaggacggcgaagaccgtagtgaatttcaagtggtggccgtcgcaacgggtggtaaggcggaagcacaatatccaaacacgtacttcttttgcctccatcatcggcgaccagtcgtctttgtgactcagacgaccaacggggacgagttgatcattcatgacacgcagaacagtgctttgcaagccggctttgccaagatcattacgggcagtcgaccgacgacgctgacagatagtgcgctgaacgtgaacatgagtcgtgatgcgaaggctaatcaatggcctcaaagttatcaggggacttggtattactataataagtacgatcacaagattaattcgatgacgcaaaatgataccgacgggttgaagctatcttatgtggcagctgagggacaaaaatggattcatattatgggggccgagcagactgctggggccggtaactttgaatacgtgcgttatcattattttgatggccgccaaattccagtcttaatgaatgctagtggtgctggggcctggttcgataataacgcctatccttcagcagccgcggcaaatcaaatgcgtgactggcaatatggagatgaatcaaagaccagtccggccgctgactcattagattaatcgagggtgtcatgatcggtagtgcgggcagggataaattaatcactgtgaaaatataatattaatataaaagccgggacaaatgcacgtaaattgccccggttttcattttgtaaagtttatgtatatattgaaaaagtcggaattgttttctgaaaataatgctatactatgacataagttaacggtgtcaagacatctaacggccggcgcattcatgtgaacggcacgacattttaaagctgattgtcgatcatgattgctgtcatttgggggaatggcgcgatgatgaagattaccgtcaacacaagtgtgtacgattggtcaaagagtaggaaatacaaagaaaaaaggtgtagacatgcagaaaaatacggaacacacgctcaaccttacgatgacgatgattttgaaaatcggcagcgcccggtcaatgattgcggctgccttagccgagattgcggcctatcgctacgagacggcacgtgaaaaattacgtcaggccgaaactgaattgctaacggcccagcggttacaggtacgccgactgatcgagaatgccaaggctcaacggtttgtgcactcgacactctttatgaatgcccagtcggcattagtcaacgtgatgggcgagttacagatgactgagaatctgattggcgcttttgaacgctgggagccagaagcggcttaatacgaacgttaagctgacgagtgaaaggtcgcgtactggttcatgattagattttggaagatggtattcggtagcaacttagacggatagagatggggttaaaaaatgacagttacttttagtaatgaagatgatcacaagtttcataagcttactgaccaatgttttactgccaatcctaaattactgacaaaggcaaatatatcagtaccactaactacccgtaccattcagccacgccgttatttggtggtcaccaagatcaatcaggctaccttagcgacagctacgtggcaaccagtcaccggtgcaattgcgctacataagcatgaacgtttgatttatgatttgggagcgctatacgtcggccattttcaagttgccattgacgtggccggttcgccaatggacgcgccgttactgatgcggacaaggtttgccgaacagttgcaagagttaagtgtcgatgctagtcgcgtgaccagttggttgcccacagcctggattcaagacgacacgcgccatgttgaattattgccgaccacggtccaattcgaacgccgctatagctgtcgctacatcatgttggagctggtgggtcagtcgctgaagtggcagccggtgttggcggatgcggagtttgaagaaattattgatgactttagacaagcggcgtaatatcgtcgtttacactaatgattatcgatatcgtacggtgcaaggaaccgtgtcatcattagtgatgggggttgtcgagaattagttgctaggcgcgtgacaaattcatgggcggcagaggacgcattccacccgcaattgtcgtataatgaatatattcttaaaaaacgaggagaataatatggcaaccacaactcatttttacgaaacatttcaaccagaacattacgatctttatatcaatattaaccgggcggataagctgatttcggggaagtcaacgattaccggggatgctaaggcgcaggaagtgctgattcatcagaatggtttgaccattgctggtgtccaagccgatggtgcggacgtgccctttactgtggatgatgcgattcaaggaattcgaattgaacttgccaaggccggtcaaacaactttgacgattacgtacagcgccaaattgacggacacgatgatgggtatctacccatcatattacgaagtcaacggtgtgaagaaagaactaatcgggacgcagtttgaaacgaccgcggcccggcaagcctttccgtgtgtcgatgaaccagaagctaaagcgacttttgatcttgccatcaagtacgatgaacatgatggtgaaacaatcttaagcaacatgcccgaagatcatgaagccgatggggtgcattactttgaaaccacggtgcggatgtcgacttacttgattgcgtttgcctttggtgaattacaaggcaagcagacgaagaccaagagtggcgtgaccatcggtgttttcggtactaaggcccacaaggctaacgagctcgactttgctttggacattgctaagcgctcaatcgaattttatgaagatttttatcagacgccatatccattgccacactcatggcaattggccttaccagacttctcagctggtgcgatggaaaactggggcttagttacttatcgggaagcctacttactattagatcctgacaacacggccctcgaaacgaaacaacgggtcgccacggtgattgcccatgaacttgcccatcaatggttcggtgatttggttacgatgaagtggtgggatgacctctggttaaatgaaagtttcgccaacatgatggaatatgtggcgacggatgccttagaaccagactggcatatttgggaaactttccaaacgtccgaagcatcaatggcgcttcaacgggatgccacggatggggttcagtcagtccacgttcaggtggaagatccggccgaaatcgactcgatttttgacggtgcgattgtctacgctaagggtgcgcggatgttagtaatggcgcgggccttagttggtgatgatgccttacgagcaggtttgaagcagtactttatcaatcataaatatggtaatgccaaaggtgatgacttgtggaacgccttagcggatgcttctgggatgcaagttggggacatcatgcattcatggctggaacaacctggctatccagtggtcacggcagcggttgttgacggtcagttgaccttgtcacaacaacagttcttcatcggtgaaggtgaagaagtcggtcgtcaatggcagattccgttgaatagcaactatgaggcggcaccagcgattatgaaggaccaagctgtgacggtcggcgattatgccaaattacgtgatgcgagtgggcaaccattccgcttgaatgttgggaataactcccacttcatcgtcaagtatgaccaaacgttattggatgatattctagcgcatgttgatgacttaactgctattgaccagttacagttgttacaagacttacgcttattagcggaaggtcgtcaaatctcatatgcagccgttgtgccattattaagccggtttgcagccagccattcaacggtcgttaacgcggcgttgtaccaagttgcgggtaacttacgtaagtttgttacgccagattctgatgaagaaaagcatttacaaacgttatttgaccaattgagtgccgctcaggttaaacggttagggtggttgccacaagcgggtgaatctaacgatgatcagttgacgcggccatacgtcttgagcgcggctttgtacgccaagagcagcgcggccgtattagctgcccatgagttattcgaaggtaatcgtgataagttagcgaccttaccagccgatgtgcgggtcttcattttacggaatgaagtcaagaactttggtagcaaggacttattcgatagtttattgacggcgtcacggcagacagctgatgctagttacaaggctgacatttgtgacgcattgaccgcaactacggaccctgaattaatcaaacagttagttgtgaagtttgaagatgcggatacgattaagccacaagacttgcgggcctggttccggggcgtcttggctaatccagctggtgaacaagcagcttgggattggattcgcgacgaatggtcatggttggaagccacggttggtggtgacatggaatttaccacttacatcaccgtcatttcccgggtcttccatacggctgaacgtttagcagaattcaaggcgttctttgaaccaaaaatcaatacgcctggtttaacgcgtgaaattaagatggatactaaggtaatcgccagtcgcgttgccttagttgaagatgaacgtgatgcggtgaatgcggcggtcgcggaagttataaaataagttaatattcgttataaaggtagttcggtgctggatggttcagcgcgggctacctttttagtttgcaatcaaaccatgtttaatttattgccaatgatttaataattgatagaaataactaacactgggctacagcgtcagttaaatatgatatgatattggtaattatggagagtagacttgattagtattacggctaattaatagtcgtatagatgggaggacctatgatggcaagtggacatcaatctgaggcagaattagaaaatcacctcattcgaaagttacaaagcattggctatcattacgttgaaattcccgatgttgaaacgctaaacacacattttcgtgcggtcttgagtgaacgtaatcaagaacgtttaaagggaacaccactgagtgaccgtgaatttcaggccgtattaaatgatttgattggcgctaagacgcattatcaagttgcccaaattttacgtggttcggttgttcagccaactgggaaaattaatattaaacgtgatgatgatagcagcttatacctagaaatttttgatggaaaacaatttgatcagaatatttttgaagttagccatcaaatgacggttgaaggtcgtcatgagaaccgctatgatgtgctgatcttgatcaacgggatgccaattgcccaaattgagttgaagcggcaaggggttgaatttactcaggcttttaatcaaattattcgctaccgaactgaatcgtacgcacaagcaaaactcatgcgactggttcaggtatttgtcatttccaatggcaatgaaacgcggtattttgcgaatggcgatggtgagttaaattcaaacttcatgttctactggacggatgaacataataattggttgaatgacttggacgcttttacgaccactttcttgagtaaaccacggttacatagtttaatcgcaaaatatacggtgttcgatagtagtgaccataaaatgttattaatgcggccttatcaaatatatgccactgaggcaattattaagcaagctatcgatcacccccatgaaaatggttatgtgtggcacacgacgggttccggtaagacgattacctcctttaaggccagtcagttgttattacaagaaactgatgctgaaaaggttatcttcatgattgaccgtgccgacttggatattcagacggtaaagaattttagtgcctatctgcctgaaacaactgggggccagagtcccttggatcggactgacaatactgctgcattagtcaagcagctgtcctctaatgataatggcttaatcgtgacgaccattcagaagatgaataatgcggtctctaatgatcggtataaagatattctgacaccgtaccatgaccgcaaagtgatcttcattgaagatgaaagccatcgtagccagatgggcgaaatgcgaaaaaacgtgaatcattggtttaagaatgcccaacactttgggttcactggaaccccgatttttcaacagaatatgggacccgatgggcggaccacaaaagatctgtacgagaatcagttgcatcaatacttgattcgtgatgcagttcgtgatggtaacgtgcttggtttttcgattcagtatctgtcgacctttgaggagactgatcatgacattacagacgaacaagtaccaggaattgatacgcaagaggtctatgagtccgaggagcgattgaccaagattgttgagcatatcctgttgaaccatagccacattacaaagaataagcattacaatgcaatctttacggtagcgaatacgcgcatggctttaaagtactatcagttgtttagaaagttggatcctgatcataatttgaaggtcacgacaatctttacgtgggttgccaatgaggacgacaacgaggaacaccaaaaacaggatgatgtcacttcacggatgggattagatcaagtcgtgaaggactataatcaaatgtacggtacggatttttcaacggataaattcaaagattattttgcggatgtttctaagcggatgcgcgatcataatgaccaaacgccgacggataatattgatattttgattgttgtgaacatgttcctaaccgggtttgactccaaacggttgtccacactatacgtggataaaaatttgcaatggcacggtttaatccaagcattttctcgaaccaatcgtgttgagggcaaacaaaaaccattcggaaatattattgcttatcgaaatatcaaaaataagacggatgaggctgtagcgttgttttcagacggggacagttccggcttcttagcaccagattatgatgaattaaaagatgaatttactgacaagattggccagttactggcggtgactccggatgtccagtcagtggatgacctctataaccggggcgatgacgcactatatgagtttgtgatggcgtttcgggcggtcctccgggtatataatcgtattcgcgtgtatgatgattttgaatgggtgcaatatgaacctgaattttcggatcagctgatggaagcctttcggggcaaatattttacggcgtatcaaacgatttatcaacgcaaaacgcaggagcgcgtctcaatattagatgacgttgactttaacattagcctattggagactgataccatcaacgttgactatattgtgaatttaatctcgggcattgatttgatgtcgtcgaccgaacgtaagcaagatattcagaaaattgaacatttgttggataatgcgaccaatgatcaattaaagtcgaaggttgaattgttggaacaatttttgaatgaagttttgccaacgctcgatacagacgatgatatcggcatgtcgttgagtaactttatggccgagagccagcgagctgccattaagggcttttcacaagaacaccacctttcggaagacttcgttaacgagcagatttctgactacaacttctacggtaagaccaaggacaaagagattattgacaagttaagtgctaatgggctcggctttcgagagaaacggcaggccaaacgcgagattaaggattttgtatcgactattgaccggaagtattcactaagctaggagaatgaatttaatgagtcatattgaacaggccgaacaacaggctgaactacaaaaaagattatgggctgtggcaaatgatttgcgcggtaatatggatgccagtgagtatcgaaactatatcttaggattgatcttttatcgttttttgtccgaaaaagttgaaaactatgcaaatgagttacttcaagacgatgatgttgactttgcagatgcggaacaagatgccgatttgatgcaagatttgaaggatgaagtgattgacgtcttagggttcttcattgaaccacgatatctatttacgactatggtcaagaagattaacgctggtgattttgacgttgaaatgttacaaaatgccatcaacgaagtccagaattcgaccttaggcaaagagtcagaaagtgactttaaagggctattcgaagacttggatttgcagtcatcacggttaggaaatacagttgccaagcgtagtgaactgattgccaaagtgattttatccttgtcgaatattgattttggtgaacaagatattaaaatcgatattttgggtgatgcctatgaatatttgattggtcaatttgccgcttcggccgggaaaaaggcgggcgaattttatacgccacaacaggtttctaagttattggcaagaattgttacggctggtaaagatcgtttgaagacggtttatgatcctacgatgggctccgggtcgctgttattacaattgggtaattacgcaacgattggaaactactatggtcaagaaatcaacggtacgacttacaacttggcgcggatgaacttgttgatgcatgaggttagttataatcggtttgatttacgtcaaggcgatactttagaggaagatcactttgatgatctaacttttgacgctgtcgttgccaatccaccttattcggctaagtggaatccagatgataagttagatgatgaacgttttcggaaatatgggaagacggcaccaaagtcgaaggcggattttgcgtttgtcgaacacatgctctatcacttaaataatgaaggtacgatggcagttgtattaccacatggtgtcttattccgcggtgctgcggaaggaaaaatccgacagtacatgattgaacatgacaacgtcttagatgccgtcatcggattaccagcgaacttattctacggaactagtattccgaccgttgtattggtcttcaagaagggacgcgaacgtcaggatatcttctttattgacgcgtctaatgattttgaaaagggtaagaaccaaaacaacttaacggacgaaaatgtcgataagattttggaaacccttgaaaaacgtgaagatgtggataagtatgctcatcgtgcagaagtagctgagattttggaaaacgagtataacttaaacattccgcgatacgtcgatacattcgaagaggaaccacctgttgatgtggataagttggttaaagaaatgggcgaagcggatgtcaaaatcaacgacctacaatctgaattatccggaatgatggccgatttagtggcgactgaccctgtcgctcaacagcagcttgaggccattaagaggatgttacaatgaaaaacgaaaatttagtgccaaaagtgcggtttaaggggtttagtgacccttgggagcagcgtaagttccatcaggtattggatgttcattcaggaaaagactataagcacttgcaaaatggagctattccagtttatggaacaggtggatatatggtgagcgtgaatgataaattatcagatgtagatgcgattggaattggacggaaaggaaccattgataagcctcaatatttaagtgcacctttttggacagtggacacgttgttttttttaactgctcacgtgaattataatttgcttcttttattttatatatcagaaagcatttgctggaaaaagtacgatgagtctaccggtgttccaagtttgtcaaagcgtactataagctcaattccgattgaaatacctcaaaaatatacggagcaagaaaacattggaaaaatattcttaaaaacagacaaccttatcgctgccaatgaggataaactagaacagttaaaaactctcaaaaagttgatgatgcaaaagattttttctcaggagtggcgcttcaagagattcactgacccatgggagcagcgtaagcttggggagctaagtaatggatttacgtatggactaaatgcatctgcaaaagcatacgatggtaaacatcagtatctgagaataacagatattgatgacgagacacgcacatttaaacaaacacatttaacctcaccagatattgatttgagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctgggaaccttgatcaagcagggcgttgaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaatctgattgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctaccattgattttatacgtgataatagttatgtattgaaattaggtgatattgtctttacgcgaactggagcaagtacaggaaagacttttatctacagaactgcagacagtattgtttattacgccggttttttaataaaaatgtctgttagagaagacatagattcagaatttgtttttcaaaataccttaacaacatcttttaatagatttgtaaaagtgatgtcgcaacgatctggccaacctggaatcaactcaaaagaatatgcccgctttaagttatatattcctaaactaaaagaacaggtattggtgggtaacatgctattgttgattgataaccttatcgctgccaatgaagataaactaaatcaactcaaaaagttgaagaaatatttaatgcaaaatatgtttgtttaaattcatggattttttacgggctatccctgctgaacagcgatagtattaatttatttgtaagtgtcaattttagccaaatgaataattattcatgtataaatgagttagcggccgcacaagtggttgttaactcattttttggaggtttcttatggcacagcatgttaagtttcatcagtatttttttcagtggatgcagctctataaattagatgcggtccgtccagtgacttatcgcaaatatgaaatgtcacatcggcaattggtaatgttagcgccagatttaaagatggctgatttatcaaggttgacatatcagcaattgctcaatgattatgcggaaacccatgaacggcaaacgacaatggactttcatcgtcatttaaaaggttcacttattgatgcgttggaagaagggtttatcgatcgcgacccgacacggaaagcaattatcaaaggaattaagcatcgtcaacataaaacgaagtatctacatcagtatgagttgcaggcattgttaaatgaattaaacctgaataacgaagtcaattgggactacttcatcttactgattgctaagactggaattcgttttgcagaagccttaggtgttactcctgctgatttcgattttgctcaccaaacactttcaattagtaaaacttgggattataaatctgccaaaagtgacttcgcacctaccaaaaataattcgtcagttcgcaaagtaccactggattggcagactgtgattcaattttcccagttgactaaaaagctgcccggagatcagccaatctttgttcaagcaaaagtgtataatgatacggttaatcattatttggagcgtctatgcaagcacgcatctattcctgtgatttcagtccatggtttgcgacatacgcatgcttcattattattgtatgcgggtgttagtatcgcttcagtagctcgacggttaggtcattctaatatgacgactacacagcaaacttatttacacatcattcaagaattagaaaatcaggataacgataaggtcatgaaacatctggcaagtctaatatagacgataggatttactttaataagtgcatatcgaaacgtcctcaaatgctgagggcgtttttcaaattatactcattggcagcgataaggctatttaaagttacaaaacagtctccaattctattttgttcactgtatgcaggtaattgaataggtgtgtttttcaattgaataattgtgtaatgtgaaatagttcctatatgtgcaattgaatgtaggtattttctaaatatattagtcttaaaatatgaaactaaaaacttgccattaatgttcttagttctaatccacaatacatctgcatccttaaaataaattggagagtcgtcagtaattctataggctgttccaattgacccaccgccagtaatcaatacatcatcagttttaggtgaacctgtttcagcacttagtttattgaacaatttcttttcaataaagattctattacgaacaatctcacggttactcatcttaacaatatcgctggatcttaaaaatctaatcccatgctctcgccaatcaccttgatgaacacgactagctgacccaatcatggaaacatccttcagcttacgctgctcccaagttttcaggcttatcggtcatatattaggaactggtacttgggagcagcgtaagcttggtgattatggaaatatagcaatgaataggcggatttttaaagaggaaacttctacagagggggacatcccgttttataaaataggaacgtttggaaaaaatccagatgcatttatttcacaaaaaaggtttatagaatataagagcaaatatccgtatcctaaaaagggagatattcttatttccgcgtctggaagcatcggacgtacaattgaatatcaaggtgaaaatgcatattatcaagattcaaatatagtgtggttaaatcatgatgaacgattggttaatagctttctaaaacagttttatttaattgtcagatggaatggcttggaaggaagtacaattaaacgactgtataacaagaatattcttaaaaccaatatatgtgtgcctttagtagatgaacagaataaaattggaaactttcttagcaagctagacagccttatcgctgccaatgagcaagtcccaaaattagtcattaaaatagtaaataattctctagctaattcatcgttttccaactaatggttatgattagatataggacacttagcgtgagtaaaatgagataaaataatcatcttaagcacagcttgaaagttggcttcaatctcccggagagtataaatcaataattatgccacatttggtttaatactagtataattatcaagattaaaaataattatgctgatttgtgggtgcttctgcattatttgaataacaaccgtagaagcagttttgaaaaataccaattcgcaagccaagcaaaaatgccaagttgactagctcataatctggttaaccatagcaaatgaagtaatgtttccctaactacctaatcaaccgcaataacacgcacaccacaataatccacgtctttctgatcgccaaactgtcgcatgacctcgccgtgcgtgacgcaggcgatacaatcgtaagatgcggcatacttattcaaagttgccaaaactcgggccttcatttcagccgccgattcgtaggggcggggactagcagtggtgcgtttgccggcgtgttgtcgatagagcttgtaggccgtggccgcttgttcatcggtatcagtccgaatacccgtgttatcgggtagccactcgtgtaatccaagttcgacctttagtggaatatcattaaaacgcacaatttccagtgccgtttgtaaggcacgcgtgtagggtgacgacagaattaattgaacttgtgcaaataacggctgctgggcgcattgttgtgccagcataataccacggtcggttaagccccgccgagttcacggccgaaaccagttaatccagctgtagtgacctgttgataagttggttcggagtgacgaatgagatagactttcatcgattaggacttccttcatcggaattataattattaatttcattataggcacctttgaccagaaaaaacgacacttcatttttcgaagtgtcgttttcgttagacctgatgacgttatgattgccgatttttaccatagaaaccgagtgtgacgacggataataacagtcctaggatgaccgctaatttgccagtctgttcgtcggtttgtggtaactgggctgaatgttcagtgacgggactcgttattttgaccaaacttacctggtcggccgtgggtttaagcgttggtttcacggtcgctgctggttttacagctaccgctggttgagtcggtttaataccgtctggctgcgttacggtcgttcctggctcgttaggcgtctcgggtgtggttggctcaacaggcttagtcggttgttccggttgttcgggatcaataatatcgtcggtaccagtcgtgtcagttgcttggtagacgtacgtgacgtccacgttatcagcagtgaagagacccatggcattttccggctgaccaacgagttcatgatcagtgaatgtcaggggcacggtttgataagtggttcccgtcttgccgctcagcacggttggttcgttcagtttaatgccatccttagtcacgtaatgtaccgtaacggttccttgggtatctggaatcgtgggggtgttttcagtgtaaacgtaggtcaaagtcttcgcggtagttccgaacgtcccactgacgtcaccctgcacagccttgaaggtgtaaccatcgataaccagctgttcagtcgagtagccgtcacccaaataaccactgagaacaacgtcaggatggatagacttaccatgctcatccagatacttgacagtgacgggtagcccagccgtccgttcgtagacgtaggtcacagtcttcgcagtagtcccaaatgtcccattgacctcgccttgaacagttttaaaggtgtagccgtcgataacaagttgttcggtcgagtagttgtcacccaaataaccgctgtgaacaacgtcaggatggatagacttaccatcttggtcctgatacttggcagtgaccggctgtccagctgtccgctcgtaaatgtaaacgacgcgttgtggctgcaaagtatagtttccagtcgtgttaccctgtgtcgattttaccgtatagccgttaatgttcagcggtgatgtttcatagggctgtcctaattgaccttgaccgcttaatacgctatcggcggttaactgctggccgttttcgtctaaatactgaaccgtgatatcgcccgcatcctcgcgagtgtagacgtagatgacagtttgcgcttggtcgctgaattgcccagtagcgttcgctggcgtttgaattaagcggtagttttcaatcgtcttggcgtttgtctggtaggggcgacctagctgaccgttaccggttaggatgtcgtcgggagctaaagtcgtgccgttagcgtcttgatacttcaccgtgatatggccagcattcgagcgcgcatactggtaaataacagtttgcgtgtcggttgaaaaggtcccggtggcgttcgcgggtgtggcgactaggtaaaagttaggaattgaaatggctgccgtttgataggctgctcctaactgctctttgccgtctaaaaacttgtcaggtgctagtgggttaccagcactatcttgatacttaacaacgatctggccagcatcgcggcgcacatagacgtaaatgaccgtctgttcctggtctgtgaaagtgcccgtggcgtttgccggcgttgtcatcagggtgtaattttcaatgcctagtggttcagtcgtataagtttagccgagtgattgggagccggaaactgtcttatcgggctttaattggtgtccctgcttgtcttgatatttcaccgtaatgttaccggcgtctaagcggacatagacaaacgtgatgctttgcggatcagtcgtgaaaacgccagccgcattgccgatagtttgctgtaatttaaaatggtcaaaggttggcgcatctaaattgtaggcgttaccgagattgtgttttccaggtagaatttgcggttcgtagactaagttgccattagtatcgaccatgtgaatcgtaatgtcgccggcgtccttacgagtatagtaataagtgacggtctgggcatccgccgtgaagacaccactggcattgccgacaatgttcgtaaagtcataatttggtagctcgtcatcaatgcgctgagtcgtgtaaggctgaccgacgattccgtttaaggtgaggtcagcggtgactaaggattcaccggtaagcgcgtcgacgtatttgaccgtgatgggcgcagcagtggcagctaagacatacgggcggacgacgacaaagttgttaccgtcagaagcggcagtcatgaaataataatcgtccatgggaataaccgtggtaccgttaaaggtcggacctgttagtccgggttgctggggcttcatattcgtgtagtagatatgaccgttgctgtcgtaattaccaccgcccgcaccgttaaagtaccagcgaacgtaaagctgaccgtttttgtagaaaacagtttcaccgacgccattattgggcttcagttgaactttagagccatctggcaaatagcaatcaatcgccagcgtcgcaatattattatctgcactaatataggcgggtggtaaggtgataaattggttactgaatgtgcctttcagatttttaaatcctttaagtggcgaaaaatctgaaatgtggttataggcggcatcgacctccgttaaattctttaagtttgcgagcggtgaaatgtccgtgatccggttttgctgaatattgaccacttggagtttttgtaagttggctaatggtgaaatatcagtgacatcactatagtaactgccagacggtgcgttcaagttgttgttgagccagactgtcgtaaggttagtggcatattgcagtccttctaatgagtaggaagtcttgccgtcgatataagtgtccttgccatagtaggtggtcagtagtagcatatctgccttagtgatgtctgcagctgagttccaggtacgatctgggttctgtttgcgcagttgactgagtacctcttgttgcaataatgtgttcggcatccaatcgttaatattttctgacgcggtgcggctaatggcacggacgactggttggttagatttcaaaaccagcttttcctggtttacattggtaacaattttatcatcggttgacgctgagctagtcgctgactgagtattcacctcggtggtagtggagttggacggcgcgggtgcggcttgctggcttgattgcttggaagcttgattatcggttgtcgttgctttagcttgactatcagtcgctgattcagtgtttgattcggtagttggttcagtagttgatgcggaggttgtttgagctggtgcggtttgagttgggtgcttaatatctgtggtcggtgttgattctgacgtggtagttgcttgagattgtgatgctggatttgctgattgttgttgtgggttggtgttcactgacgacgagtgctcagagggacttccggttgatgtggtgggtgacgtggctgcgactgctgactggtcggattttatcgtggatactgatgtagaagtatccgctttcaaattgacctgagtagcgttaacttgagtattcgtattcaactgactgttggtcggttcgttggttgtggtcgtgactgtattgtcggcagccgccgcctgactggcaatcgttaacgttgtcagtatcatggcggttgcgctcgtgattacccatcgcgattggtgacgtttattctgattattaacattgtttggtttcaaagatccccactccttcaaaatacttatataatgtcgttgacaatttaagggtaacattgtcattgccgttagtctaataaatgataatttaattattgggagctaattgtatctgtcaatgtcagctggctgcataatagttgacgtaagcataagattgattataatttaaatagtaataattactatttatcaggaggcacccatgatggaaaaacaagatttagcaagtgcgcgcaggcgtctacgggggaccaacttaaaatcgcggaaacgcgcattgaagattttacatgatgcccgacgtaacgccagtaaagccaaatagtatcagcgaacgttagccaatttggctaacgtttttttgttagctgtgcggtatgattaagatacaggaatgagtggaggacatgtggatggaaacaactttggtgattattcggggaaattctgagagtggcaagacgacgctagcgcaggcgttgcaacgacgcgtgggccatcatacgttgctagtgtcccaagatgtcgttcgtcgcgacatgctgatgagtcatgattacccgggaaatatttcaattggtctgattgaacaaattgcgtgttatgggctgggacgtgtgcctgtagtcattgtggaaggcatcttagcacgtgatcggtatggaaaaatgttggcgcggcttagtcaatcgttttcacgcgtccttacttattattttgaagtgagctttgccacgaccttggcgcgtcatcaaaagcgtcatcgtgattttggtgtggaagacatgcgtcggtggtggcttccacatgatacgttgggcgttgctaacgaagtcttaattggcgagcaacaagatttaaccacggaagttcaacaaattatgactaccatacatgattgtgactaaacaaccatgagttgattggtttgatcgtggttgaggattaagctgaaatcataaaggggggcgagccaatgttactcgcagcattattgaaaacgcgtcgctgtcagtatggattgacacaggcacaattagcgtccaagttatttgttacgactcaggcggtgtctaagtgggaacgcggaaaggcgattccgtcaatcgataatttactggcactgtcggatctgtataatctatccttggatgaattagtgcgtggtagtgctttctttccaaagccatatattgttggtcggcgactaagctttgggcgacttctgggtctcggattattttggctatttgtttgtctattatttactggttttggttatcagccgtggtggctctttttatcactttatattgttggattgattgtggtcgttccagtgggaatcaatagttactgggtgattcagcctgctaccattgaattgcatacgtatgctgcatcgacattgacgaagtttcgccaaattgtgttcaattgtccacggtgccaactaatccactatacagatctgcagcgagttaccatcagttatcggtgtcgcaaacgactttcaccatttgatttcaatccggattattttcaattgattttaaagactaatgcccaaacttatcagctggaatgtgcgttgaaggccagcgactatttaccgcaatttgtcagttatttgcaacgacaaggtgtgacggttgatgatcctcaacaagttgtggaattgttagtttcaggaaagtcgttgtatcagcattttcataccgagacttgatcttgagcggttgcaaccaaccgttgcggtagcgcttaagtgtgttgcaatgaattggtgcactcaatagtctagtattgtaatagaggagcaggtaggatgaaaattgtgattggcagtaaaataaaagagcaacgacaacagcatgaatggtcccagcagacggtggcggagcggttacacgtctcacggcaaactatttccaagtgggaattaggaaaaagttatccagatttagagttattggtagcactgagcaaactatttgctgtctcaacggatgagttattaggtttgagcagaagacctgttcagcgaccatggtggcagttgttattgcgtaaaaggagtcgaacagatatgacggtgaaatggtacagcggggggcaggatcgggcacgtgttgctgtgggcataattagtgatttagttgctaatctaaataccacgaatgagcaaccgttacgacagctgctggcaacttattatcaggaactattggaacaacgaactggttcagtactgggagtattcgacagaatgaacttagacatctccaaatgtctgcggcagcaacaaatcaaactatcaccagaaaatgagcaactaatgcaacagctggtggggttgaacatgatttactaccggtgatttattttgaaagtaaaacgcaaactgtcaatcatctagcttaatagatgctgacagtttgcgttttatgttaaaaatcaatcgcagggttaaaggtttgacaagcttgttcgactagataagcaatcggtttagctagcacgtgacttggtaagtaggcaatactaaaatcaaggctgagctcgcttgttggtaatttgaacgcattgatagggtacttggctggttcagtggctagtcttgccaacattgcagtggctagaacaatgctaccaagtccttgaagtgtcaagcttagtgcaaagcgagagttatcgacttcaatgagtggaatcgtttgaatgcctttatcggcaaagtaatggtcaaccagttcttgaaagcgagcttcaccgactgcacggatgacaggctcaccggtcattcctgtaagaatggtgggggtgaacggtcgccaaaattgattggactgatatattccggctgtttttggaatgactaaagacaaagaaattgtctgcaaagggatggttttgacgttagtttgatgaattgttttgccaataaaaaagtctagctgatgactagctagcaacgtttctgcttttgatgttgtgatttctagtattttagtgcgaatgttcggaaaacgttgataaaaagcaggtagtgtttgactaaaccaagcattagccatcggtggtgtaatcccaatcgtcatactttgatacttattttgactgatttctttaagctcagtgttcattcgctgatggagacgagcgtcactttgcaaataagtcagtaatctttctccagcataagttaattcaagtggatgatggccgcggtcgattaagggggtcccaaaatgagtttccgcacttttaattgtgcggctaatgtacggctgactgatgaataaactttgtgcagctttcgtcatactattgtgctgttgaatagcttctaaaaatactaacaatttattttccatgaaatcgctacctttaatgcttaatcttattaaaatcaagtataacccattactcatttgtaataacagataatcagattgttatttctataaaaatgaaagcggttatataatacagatgtagttaaaaaatgattctgtttgtgatttaaatatcaatttcaattgtgctttagaatacgttaaatggattttgaaagggtggtcagcatgctccaaaaaatgaatcaggttaaatgggattatcaatatgatacggtagttattggctttggtggtgccggggtgacagcagcgcggtttgcggcggatgcacatgcgaaggtattgctcacggatgcagcgccgaatggtcatgaaggaggcaatacccgttattctgcccaactcttaggaacggtagatagtttcgatgagggtaaaaaatattatcaaaacttaacggcacccatgcaattagacgatagtatggttgatactttcgtagcgggcatggcgaatatgcgcgactatgttcaaaagtatctcaatgttgaaccggtgagtgtcaaaaatgattttacagctgctgattctccaatttcattagacagtgcagttcatgagtttcctgaatttgatggagtccaatcctatgactttacaactgtccatcatggcatttttgatgcagctttgtggaaaattcttcgacaaaaagtgttagatcggcagcaacagattgatgtctggcttagtgctccggcacaacatctgattcaagatcccactacgaatacaattatcggtgtccaaatcgaacgtcagcatcgtttagttaatgttcgagctaccaatggcgtagtcctagcatgtggtggttttgaaaataatcaacaagccatccaggactaccttggtgctgagcacttggcaccattaggcacgctgtttaataagggtgctggtattaagatggcccaagaagttggcgcggacttttggcacatgcaaaattatgaatcactaggatttttacatggcctttcgattgctgtaccacaaggtgaacgtggtcgcttgattttaggctggccggaagtgaaccatggtagcgttattacggtggctgatgacggtagtcggtattttgatgagagtgaagccaaccggcacggtcacatttatgatcatggaatgtggcgagtaccgcgtacaaatgtccatccatacctggtttttgatgaaactcagtatcaacagatgttagcaagtcaatatacgccgattaataatctcaccgatttagttgtgaaggccactactctaaacgacttagcacgagttatggaagttgatggtacggtacttaccaagaccgttcatgatttcaattattttgtcgagtctggtactgactacgcgtttaatcggcaggttgatacgatgcgggcatttgatgatgggccatattatgcgcttaagttaacaaacaacgtacttaatacccaagggggaccacgtcgtaatgaccgggcagaaattttagatgcaaatcagcaacctataccgcacttgtatggtgcaggtgagttgggcggtatttgtgcaaatcagtatcaaggtggtggtaatttagctgaatgcctgatttttggaaaaatcgctggtgaaaatgcagctaaacctaaggaagaaacgacacaattagtcgatgaaaaagcagtggctaagccggatgcgaatactagtgcttcggtgcatcagactggtgccaatgatttgctagctgaagcatcaccggacatcacagttggtgaacaccaatacttagggcgctcaaatgatggcattggtgggcaagttgtggttcgtatcacgtatgttgaccaacaattaactcatgttgaagtagttgaacaacatgagactggtgaagttggtggtcaggcagttgccgaattgccggcaaaaatggtggctgctaacacttatgatgtggatgcagtttccggcgcttctgtatcgagccgtgccatcaaggccgcagtcaaggacgcgctatctcaggccgaacagaccgtgtcaaatgattaaccactgatcgcacaacccacgaatcacctagtgcttttagtatcttttagtgcgtaataccggtaaactagaattaacaaattcaatcaatggaggccgctcatgcgtattacaaaaacgagtttgatcctcagcagtttatcattggtactcaacacgttgtcattgattatggcaattcgcaagtatcggttacaaaatcactaatcattagaaattcaaaaacaccgctgtgactaacgaacgcattagtcgtagcggtgtttttggttttattaagcttcataatccgtcaaattagccaagaagcgttgaatcaccgcaagttctgctggtgagtagtgttcatggaggagcgtgattgcttgatgattgcgggttgcatgcatcttatcatgatagcgggccagcttacgaccactcggcgttaagcggtagaagatctttttgtgatcatcgggttgctggaatgagccaattaagccctgcgttacgagtcgtttggctgcccgggtcacaccacctcgagtgacaccgaggttagtggctaagtcgatgcccgtttgtggaccgacctctagttcagataataaatgtaggccaacgatggaaatatccggcaacaggcggcgtagattggcttcggtgatatgctgctgtaaccatttctgttcaccagtagtggaagcacgcttggttcgaatcgttttgagctgcgttagaattgtctgttccgtggatattgacatcgattgatcccccttagatagttgtgcgtcatggcgactggttctcgtggtggttagcgcgcaattatcaattaatcattagcttttattactattattataccggttttaaaattcaccggcgagtttttctgctgctacctgtgcggcagtgatggcctgttctcgctgttctggaaattggtccaatccttcaatgaagatggttcggtaatcctgaatcccatacagttgcatcatgccacggaggtaggggtcgcctgcttcaacctggttgtgctgatcaggttggtgatagtagccacccgcagcctgaatgtgtaagacgtgtttgtcgggtaataagccgaccgggccgttgaccgtgtacttaaaagttttacgggcgactgcggttaagtctaagtattgtttgagttcggctggaagaaagtgattgtacattggattaacgaagacgatcttgtcggctgctagaaattcagctagccaggcggcgtgacggctaagtagttcagcttccactgacgttagttcttcaccgtatttttgtttacgccaagcttcgaaggttgtgtcgttcaaagcgggaacgccgtcctgataaagatcgcgtgtcgtaatctcatcgttcggatgggtttgctgatacgcagttttaaaactcgctgcaacggtcagtgaggcactggggacggtcgtgtgtggatgagcattaatcattaataattttgtcattttaaacagatccttaattttgttgacaagcaacattttatcttgaatattgttgcttgtcaacaaataagataaaaattccccacacattcgaaaatgcgtggggaatttaaaggatgcacgattaattttgattaacgaatgctactagcactaggttggagcgactttacgggtaaatacggtgcaacatacgtggaaacggaatggtttcgcgaacgtgatcttgcaaagtgatccaagccagaaaacgttccagacccataccgaaaccggagtgcggcatcgaaccatatttgcgtaaatcgagataccactcgtaatcctgcaagtcttgaccgctggctagtaaccgttccttcaagtagtcataatccgttgagcgttcggaaccgccgatgatttcgccgtaaccttcaggtgctaacaggtcagctgcaatgacgacatcatcgcgcgtcgggtgtgcctgcatgtaaaaggccttgattgctttgggatagtttaagacaaagactggttggtcaaagtgttctgccaaaaatgtctcttccggtgagccaaagtcgacaccccagtcgacgtcaaagccgttcgcttggagtagtgtaatagcattgtcgtacgaaactcgcggaaatgggagcttggtgtacttttgcaacgtcgcaacatcgcggtccaaaacggccagttcgtgggggcaatggtcaatcacggcttgaacgaggtaggccaccaattgttcttggacttccagactttcatcttgatgtatccaggccatttcaggttcaagttgccagaattctgttaagtggcgacgagtcttggatttttcggcccgaaaagttggtccaaacgtgaagattttgccgaacgccattgcgccagcttcaccgtataactggccggattgtgataaataggcgtcctgaccaaagtaatcagttttgaataattcagtcgtcccttcaggagcggaaccggtcaaaatcggcgcgtcaatcttaataaaaccgcggtcattgaagaactcataaacggctcgaatgacctcgttgcgaatccgcataattgcgttgggacgcgatgaccgtagccaaagatggcgatgatccaacaggaaatcaataccatggtccttgggcgtgatcgggtagtcgtgactagtcccaaccactacaaattgtgagatggcaagctcgtagccaaagggggaacgggtatctgcatgaatcgtgccggtgacccagaggctagtttcttgcgcgaggtcggtcagttgtgcaaaagctgtttcaccgagctcgtttttgagagctaccccttgaaaagttgcagtgccatcgcgtaattgaagaaaggcaattttgccgctagaacgcttattactgatccacaccccaattttaacttgttcattgacatggtcagcggcgttgataatactaatggtttccatgatattgatcactccttcttgttggattttaaatcagattaaagtaaatgaatgttatgttcggcacattggttgatcatggcttgtggccacaaggcagcttgtacttcaccgacatgggctttgccaagtaataacatgcagagccgtgattgaccaatcccgccaccgatcgtgtaagggacgtccgcgttcaagatcatttggtggtatggcaagctaagccggtcttcggcgtccacgtctttaagttgtttcttcattgattcagcatcgacccggattcccatacttgagatttcgatagcttggtctaatggttcataccagaagaggatatcgccgttcaatttccagtcatcatagtcgggggcgcggccatcgtgacgttcgccggaatcaagcttccagccaatttgcattaagaagacacagccgagtttcttgcaaatggcgttttcgcgttcgcgcggcgtcatgtcagggtacatgtcttcgagctcttgtgtggttaagaagtgaatttcgtctggtaagtggtgaacggcttgtgggaacttgtaccaaacttcgtgttccatgtgcttgatcactttaaagatttgacgtaccgtggctttcaaagtttcaacggttcgttcttccttactgatcactttttcccaatcccattgatcgacgtaggcggagtggtagttgtctaaatcttcatccttacgaatagcgttcatgttcgtgtagagaccttcatgcatatcaaaaccgtagcgctttaaagcgacccgtttccacttagcaagtgagtgaacgatttcgatttgttcatcacccatgtcttgcatagtgaaggagacaggtttttcgacaccgtttaagttatcgttcagaccagttttcttttcaacgaacatcggtgctgaaagccgagataagtttagttgcttcccaaattcatcttggaacgtttcacgaatgtaacgaatggcctgttgggtttctttaacggataatttaggatcgtaatcctttggaataattaaatgcatatgcgtggtctcctttaaaataagttcagattttagttacaggataaaagaaaagagccttccatcccttgaattatcaagggacgaaagactctttcgcggtaccacccaagttgtttaccttacagtaaaccagctttaaaatagtgtacaaacatacaccaccgatggtaacgtaccggttaacggctaatcctactttaacgaggttatttcagttagcaactaagaaagtgtttttcggattagtcaagttctggtcgggtttccactcactcccgattcactggcaggttgactaatcgtactcctctttcctccgttttttatcttgtgacatttatattagcacgattctggtatttgtaaaccactaaattaaaaataaattagtttagtctcatgaattcaccataaaaatcttagctaaaaccgcaagctaccgggcttaattaatcgttcaaattataacgtaatttcattttttcagaaccggcaatgaccatatcgccgagtaatttagtttgtaacttcatcgcggtatcggccaattgttggttagccgtttcaagataggccgtgacgtcttggtggttagccaagtcagcgtcggtatcattctcgattttacggtaagcactcatggcttcgagttcgtaactattccgcatatccacgtaaaagtcgtagtcggtgtcacccaaaagggcggttgtacagcttaaccagtacatgtggttgagattaaaggtgccgtccgcatctttgtagctagctggcgtgtcattgacatttgcatagaatggtacgaccgtgttgaaggtattggcaccaaaggctaaccagtgaataccggcaacagcagcggggacgttgttgcgaatctgtaagatgtgcacatcgtggttacggttgatcccgattggccggaaaagggttttgtcagcttcagagccactcccgtaaacatcgtatttcgtgttttcaaagtgagaactcaaaacgaacttgacgtcttcgatagaaatcttatggttagcatggcagatgaatggtaagtcttgttccattggatcttgcacaacgtccggcgtgaagtatttctgaccgaaccaagcccgggggttgttgtaaaccgtatctttgattgaagcactcccaaagatgtgccgcaagttgacacggtcaaagtcaggattcaattggtaatcttcaattaattgttcaaggtcagctgaagctaaggtatcatcagcgttaaaatcgaaatcgtcaatattcatgcggttcggagcaaccacgtaagcatcgtcaggaatacgtttagcagcccagtggtgaccaccaatggtttctaaccaccagatttcgtcttgatcagaaaaagcgataccgtttggttcgtaagtcccgtattgttcaagcagggcacctagacgagtaacgccttccttggcgctgtgaatgtatggtaatactagggtgcaaaggtcttcttcaccaattccgccggcaacgaagggatcgattcccaagatacgcgagttcgtggtgatggtttcggttgcggacatggcgatgttctcactgttgatccctgctgctggccaggttccattggtcaagattgagttgggaattgaagtataccgtaagggattgtcaggtaagtcgacttcgaccttactaatgacggactgatagtgccggggttgatctgcgggattgaccacaactaatcgttcggggtctagggcttcgtgaccatcatcgtttcgtgaaataatggtcgagccatcgattgaggcttttttaccgacgagaatcgtggtacatgaacctttaatacgtttttccatgatattaaaacactccttttaagctattaatatcattatacgctttctgagcgggtcgggatagaacgggcttttttgagaatataattaatcccgctaatactaaaaccggtgaccgccgcaatttcacggtaagtcttgccacgtgcccgtaactggtgaacttgcgcgtggctggcatgttgtggtgtggggctaggcgtctggattgacggaaccaccgctggcaccgtagctggtagtgcgatcggtgcaggcggtgtagtgattaccggcgtttggtgagttagttcagcaagcttaaccatgactaattcagttgtctgaacatcccaaatggcgttatgctggtgtggattgctgatattaaaaagtgcggctaagccatttaatggcagatcatggctaccgaccttatggttgccacgattgatcaaggtattcgtataggcttgggcatcaaaaatcgtgaccgggcgactgattagctgctgttcggtgggggtcaattgctgataatactgagttagtaataatcgaatgtgtttcatgtcctgtgtctgatcccaaaaaacgagggggagttgtggctggataacttgctggatgaatgcttttagaatcgtcaaggggtcgccttgcgcctcgtaagcgacggtcgttaagccagttgctgataaaccggccaactttttgtcaggtaaaaagttaggatcatcgaagtaacgattgaaaaaaggcgctgtctgcgtatgatgggaaaaaccgatggcactgagctggaagatactagcccgtaattcgggtgattcgatgacgtgccaactgacggctttagcggagccattacgacgaaagcgagtgccgaactcgcagtcgatgattacgtaagcggtcggacattcactcaattccgttggtgaaggtaggatcgtgggttggcttagttcaccggccggctgcgcagggggaaactggtatcccagcgtcgccagaaattgaacggtatcctgcccgagctggttattggttactttagcgaccttcttttcagttaagacaatttctttgcgcgccacgaataaaatatgatagcgctgctgttcatcacagataatttcggtcacgttgccggcaaggctgtattctgaagcgagtgctaattgatggtccttttgaatacggtaaacgggatggttgacaaagtatagacaattcaagttatttgagatcttacgctcaagtaaggttaggttcgttggcatcatcgacaacagctcctctgatctaagtacttatattttagcggctttgtacattagctggctagtgtttgcactgcagatcgaaccatgaatttggtaatcacgaattggtgcctggtgttatagtgaccgtagagtgctagttgtgcgtcaggttggagttggtaaaataaagtcaacgcatgcttgacgatgatgcaattgatgggcgtaggttcggtcgcctttaatggcgtgacttgtaagtacaacataaaggggtccaactttaatatcttgcttttatttaaatacttaactgttagattttctgactgcatgctaatcacctcaatacgagtatacgaacatacgttcttaaatgcaagcaaaataactgcgttaacaaatttattttaagatgagcgctaggtgcactggactgattcgaaataatttattaaaaatcgcaacgaatcaggcaagtcacggggaaaaagctacaaaaaattgagaactcttggtatgatgaatagtagtgaatgagaggaggccgagtcatggatcgaggacgacgcgcaacgctggaagaacgaattgcgatcgtaaagtatacgctggaccattgcaacgattatcgagaagccgctaagcattttaatgtttcgtatccacaagtctatacatgggtacgaaaatatcgacaacacggcatggaaggtttggtggatcaccgtggccgacccaagcaaggctaagtcagcattgtacatataaactgtgtgggcgagtgccctttgatggccaatctgacatggtcgtttaatcgatatcggtctctttaaagtgtccgttcctataaaatcaatagggacgggcacttttcggtattttgatagttttcgtggcgcaagtgcgacttaacgtacctagtgattaccggggcgcgttcttgtcatgggccggtattctcggtagaatgagagtattaattcaaagagggagtttacgtgtgatgattgacttagcggcggcacagcaagtattaaagaccacattcggatatgatgaattccgaccggggcaaaaagcagtgattgaacaagtgttggccggtgaaaacaccctagcgattatgccgactgggggtggtaaatcattatgttaccaaatcccagcgttactttttcaggggctgaccgtcgttgtctcaccattgatttctttaatgaaagatcaggtagacgcgttaaatgataatggcatcgcggcgacttttattaacagttcactggatttccaagagattaacgaacggctccaagaactacgggcgggggattataccttactttacgtggcacccgagcggttagattcggattactttattcaagcgctgggccggttgcccattcaactgttagcaattgatgaggcccactgtatttcacagtgggggcacgattttcgccctagttatttagcgctcagcacggcgatcgaacaattgccgacccatccgcaagttctagctttaacggcgacggcaactgagcaagttgctgcggatatttgcggccgcttagcgatcgatccacaacatgaagtgaatactggttttgcccgcgataacttggatttgacggtggtcaaggaccaagacacggaccgttacattttagattatttgaaagttaatcatggtgaagccgggattatttacgccagcacccgtaaagaagtgatgcgtctgacgagtttgttgcaaaagcatgatattaaggccacgccgtaccacgctgggctagatgatgcggttcggcggcaaaaccaagaggatttcttgtacgaccgtgttgacgtcatggtggcaaccaacgcgtttggaatgggcattgataagagtaacgtgcgttttgtgattcacgcgcaagtccccggaactttggaagcttattatcaggaagccggtcgggctggccgggatgggttacctagtgaagcgattttgatttttcgaccggttgatattcaacttcagcacttctttattgatgagtcggagatggatacggagcaccgacacctggcatatcagaagctacaggtgatgacacggtatgcgaatacccagggctgtttacaacagtttatcttgaaatactttggtgaaaaatccgcgccgtgtggtcggtgtagtaattgtactgatcagcgggaatcacaggatatcaccacggcagctcaacaagtcttatcgtgcgtcgttaggcttcattcccggttcggtaaaggggtcgtggcccaggtattgacgggcgctaataatcaacgggtccgcgaatcgaacctcaatacgttgtcgacgtacgggttgatgtccgggcagcgacagaagagtgtcgtggaactgatcgattttttgactgcgagcggttatttgcagtcggtgggtggtcagtatccaacactgacagtctcagcgagtggagtggccgtgcttaaaggaacgaccacggtacaccgaaagacggcccaaaaggtgcaacagacggtaccagagaacagtgccctcttcgaacagttgcggacacttcggcgtcaattggcggaagaacagggcgtaccaccatttgtgattttttctgaccggacgcttcattcgatgtgtgacctgatgccagaagacgacgcagctttcttaacggtcaaaggggtcggggccagcaagcttgaaaagtatggtgaaacctttatggcgacgattcgagcggcagctcatgcggaatcagcaactagcaccgatgaggaaactgattagatggctgattggtaaactacgagatgaaatggagtaacacgtatggaatttacttggcaacaccaggggcaatcaatggcaatgaaacgattcttgacgacgcatgccatcagtatgcgaacaatcaaggcaatcaagcatggcaccggcgcgtttcttgtcaataatcaagttcaaacgggcgttattaccattcatgatggcgatattgcgggaattcaactaccagacgaggcaccggatacagcggtagtcgtcagcgaacaaccaatccaaattgagtatgaagatgctaattggctcgttcttaataaaccagccgggttaaccagcgtgccggggcctagtaatcggaccgatacgttggtcaatcgaatcaagggttatttgatagccagtcatgccagtaatcaacgaccgcacctgatcacgcggttggaccgggatacgagtggccttgtgttagttgctaaacatcgggtggcgcaggggatgctgacagagccccgaattgcggcgcaattagtgaagacgtatcaagcttggatcgaagggaccattacgccggctagtggcacaattgatcgcccgattggccgggtggctgacagtcctcggcgagtggttactacggcgggccaacgcgccattacgacgtatcaagtggaggcggaccaattgcagcataacgtgagtcggttacggttggaacttgtgactggacggacgcatcaaattcgggttcatctaacggcgcttgggcaccccttattaggtgatacgctgtatggcggtaacttggcgtggattcaacggcaagccttacacgccgctagtttacagttctttgaccccttttcggaacagactttacactttgaggcggcattgccagctgatctgcaagccttgaatcacgactaagttcagtttaagaccagtgaccatccggatgaatggttaataaaaatcggcactgctagaatgcgttgaacattctggcagtgccgatttttggttggcaaccgtctaaaatcaagctaacgtttagcgggtaagttgcaggcccgcgttatcctgaaggctgcggtgactattgaatgaggcgctagtgcttacgactgactaagtggcgcgttatcagccgttagcgtcgcaaaggttgcctgtaattgctgtaatggtgcggttaacgtgagaaaataaatatgctcgaccccgttactacgcatatcaatgaccccagcttcacgcattaagcgtagatgatgtgaaacggcggggcgtgaaatattgaccaaggcggtaatatcagtaacgttgagaccattatcactgttccccagagcaatgataatctgacgccgaattttttcggcgaagatattaattagtgtggcactttcaataagtgccgtttcggattgttgaaaattagccatggtgactgcgtcctttcaaattcaatttacacttaaggactaactccccccatcggcagtacgctgaattagttgttaagtgttggtatgacagctcgatgttcaagttctggtgaaatagttgcagcaagaaaactttaagtctacaagttgtcagttagactaattgttattggaacgttcgtacttatgtataattaaagcaagtcgttaatcgattgtcaaacctttttgttaaaagtaagtactattagcgggtttaacaatttccgttcgtttgataaccatatttttatgttgaaatgcgttaaaataaaaatagcttttgaatgaatgatgggagtggaaaatgtgaaagtcttaggaatattaggtgcgtatcgcgctgatggcgtgactgcccagctactgcaagccgtcttaaagggggccgcggccagcgctgacacggaactagtcaacctcaacgattatgagttgcgaccagatcacgatagtcaaccgaatgatgacttagacgcgctggaagcaaaattaatggcggcggatgtctgggtattagctgcaccaacctatttggggagcttatcgggggtaatgaaaaacttctgtgactgttttcgggggcggatcgcacggtttaattccgtgggtgaagcagtacctgatcgctttaagaacaagcattatgtgacgatcacggattgttacgcgggtggtattgaaaattatttgaccggcgtgactgacgcaacgtttaaaacacttgataaatttttgacgatgggtggtctcatcaaattacgggagattgtcgtaactaaaacgtggggtatgcaaaccatcacagctgctaagcaagcagaatgtgaacgggtcggcgcgcgggctgcacataaaaaggaaagggatgacagtacggtgaaacggtatattcaattattcttcatgattgcggtgatggcactactaacaatgggaatcgaagcggggattcaacaattgattccgctgaacaatttttgggcctactacggcgtctttgtcgtcgtcttttatgttcttttagcaatgattttacatttcttcactgttgttaaacaccggcgtcgttaagggatacggcatgtgcattcagcaacaacgacattaaaattcaattgattagcaagctgggcttggcgtcttaatcgccggaggtcagcttgttttgctataataagaacaattacgaagtaccagcgattatttcagtgtccacgcgtataattaatatggtatcgtcgaattagaaaatgaggacacttggtactggttgccaggcgtatgaaccataattaaaacatgttaaattagatgaatttttatttggcagcatgctgtgattggtttcggttttggcgcatccaagctgccggtttttgaatctaactttgtcaaaaactaatcatgggtcatgcccaaaaacgtgttattgatttcaaaattaattttgttaaataaaggctgtcaatcaaggtacgaggaggaatagcatgcaagtttttggacaatttattgcaacagtcggttggctaggattggcactagtcgccagcgaactaggtgcgacgttaatccattggctcggtcagtggggcggatttcgattaattggtgctcgaattgtccggattaccggttttcgacttcaattaagtcgggttcgtggtcattggaaattagaacgaccgctgacgcgtcatccacatatcgtggcagcacccccggcggatgccaaacggttcaatcacgccatttattgttttggcggtggcctgttcaacttactgacggtcatgctcagtttaataactctgaatcaatttaagtttagtttcgatttatggttgttttcgttcattatttggatctgggtcaatacgttgaaagccgcccaattattaccaatgaacttgcacggttatcccacggcgggccaggaatttcggcaggcacgcgaatcaacggcggcgatgaccgccgcgtatgtcactgcgtgtgctgcggccgttaaggttcagactggtagtgtccgtgaccttgatgcgagtatgattgttatgccgcgcgatggtggcaatcggaattatttagtcgtccggcaagcctggttgattctggaatggggacttcaacatgggctggacacccccgaactgttagcggggttgagtcgcttggagccaagtttcaatacgttgccgccagctgatttggcgaagtatttagatgcgacattgtactggaacttggtcaccaatcatcgtgacccccagatcatagcctggtatcaagatgatggtgttcaacagttattacgtcgttaccaacctttggctcattataagttaactgccgtttatgaatggcgggtccatcagcaacctgaacaggccctggcattgattgaaaagggaataaaaattgctcagcgcctccacgatgaggaagaaattgcttggctgaaagctttacgcgttcaagtaacggcctagattaccgtagaaacttagattctgttaaagattgccagaatcgaagtttgtattggaaaatgggtggtaaactggtgaccattgaagtgaaaaaaggtgaaaatgtgaaacagcgaatcaagcaacggtgggggttgtggttaacactgctggtgattattttaggactaatcggggttggattgacccgagttaatgcgggactttatcagcagacagttgcacaagtgacccacgtgcagactaagagtcgaagcacgacgacggatgaatttgagaataaggatgcgacagtgacacagttggtaacggtccgggtgctcaataaggcacatcgtggtcgaacttaccagatcaagaatacgtatacgcgctcaggcgcaatggatcagccgtatcacgtccgtaatcaagtcttcttacggattcctagcgatcatagtagtgcagtgacgattcaggggttaaaacgagataccgcattggcgtttgtcgcgtggttagccctagcactgctcttgttaattatgcgtttcagcggtctgatggcctttttgagtgtcgcactcaatgctgtactattttatgccgccattcagatcgatttagctactaatggtggtcacatttacctgctctttggcgtattggccgtaatcttcgccgtgctcacactgttgctagttctcggttttagtcgtcaaatgttagtaacattgggcgcgactgtggttggcacgggactggctgtcattattagtctgatcgtctttgcggtgacccatgagcgtggtgtgacttatgaatcgatgcagtacgtgacgcaggttccccgaccgttatttttagtcgaaacagtcctcggttcactcggagcagtcatggatgaatcaacagatattgttgcttcattgtttcaattgaaaacggagcgcccggacattgcaccacgacaagtatttaagtcgggtattcaaattggccggtctattatgggacccttgatcaacgtgctatttttgattttcatggcggatactttcgcgatgactttgctctatttccgtaacggcaatagctggggttacacttttacaatgaatatgtcgttggggatggtccaaagtttgatttctggtatcggtatcgttttagcgattccagtagccagttggttagccagtcgattgatgcctaaggcggtgatggcatgaacacgattaccgttttaggattgatcttactaggattgctgacattaattggtggtaagaatggagcgacggcctttttgagtttgttatttaactttggattgttgtttttagccgttgttttgatttcatggggctttccagcaatgggggtgtcgttggtcattgggacaatcatcttggccttcacgattttctttggggaggacaacgaagtggcggccaagccagcttatattgcagcattgattgttatggtcattttagtgctgattatttttcccgttgaaaattggatcatggcgcagggctttagtttagaagatagtgaagatctggaaggtatgtcgttagccattggggtctcctttattggcgtagcagtaactgaagcaattttaagtacactaggggccattgcggaagctgctattgcgattgcggctggtctgagtgaaattctggcgcagcatccgcagttgccaactaagcgactctatatcgatggtatcagtattggtaagcagattatcgggacgacttttaataccttgtttttcggcttttttggtggcttcttggcgctatttatctggtttgcgggcttacattattccttcgggagtgttatcaataataaaatatttgttgcggaagtattaatggtattattctcgttaattggcgttatcctggtagttcccgtcacgacgtgggtgatgacgattcaacatcggcaacaaattaagcacaacgattgacgatgaccgcgggatttgctacggttgagaaaacagttgggagcgttgtgatgatggaaattcgaacggcacaaccgcaagatagtgctcaaattgcaccattgattgcgatgatttaccgtgatatggaaatgccagtcttaaaaaatgttagcgaggccgacctattggcaatgttgactgagttgtatcagcgaccggccaatttagatgggttagcgcagacttttgtggcggtcatggctcacaaaatcgtcggtgtcgcgttcgggcacttagcgaagaatgaagccgctgtaaacgatttgttgcggacgacttcaggtcatcatgcggggtttgaggcaccactggaattaggtggtgagacccggccgaatgagtggtatttaagcatgttggcagttgatccgcaagctcagggccacggagttggtagtgccttactagaagcattaccaggactcgttggtcaactgggggccacgaaactgagtttaaacgttgatgatggcaatccccgagcagctaagttataccaccggcatggttttgtcccggatggtcagctcatgattggcacacatccgtaccagcacttggttaagcctttatcataataactgaaatatcgtggtgtgtttcttagaccacggtatttttttacgtcattatggcactgaagacttttctattgagcatgacacagttagaattaaactattgaacggattaggaaggtgaacgtgccatgcagatttatttcattcgtcacggtcgaacacaatataacttagaacaccgatttcaaggtggacgagcagattccccgctggttgctagcggaatcgatggggcaaaggccgctggtgattacttaagaaccacccaattttcagcagtatatagcagtccgcagcaacgagcgctggatacggcgaaatacattgtggctgccaatcagtggcaaccgtcgattcaaatcgacgatggcttgcgtgagtttgattttggtgattgggacggcaaacaggaagcggaagtacagccgcagtcctacgcccaagttatttttactaaacccgccgaataccgaccggaactagctggcggtggcgaaagttatgcggattttgtcactcgaacgacttcgacgctacatcgtttgattgatcaagttggggtagctagcacgcaaccactattaatcgtatcgcacggcctggtgacgacgatgactgtcaaggcgttaatgggtgtccccgtagcagaattacgagcaccttttgtggtcgatgggcaagttatgaagacagtcggccacggtatcgtggataatgatagcctgacagtgttatcgacgacggataatcagcattttgaactgacaacttggaatgaaaccgggtacttgaagtaaatggctgagccaagtacaacgccttactttagctgttaacttgactctgatcgataaagttttaagtagttagtaaagggacgcttctggcatggtttgtcaggagcgtccctttgaaattaacggttgattcaagttatttgtctgtgttccggttcaaaactgttgttaatgtgatttatagtgagcgctcgcacgtgatagtgctttaccacagcccactaaaaatactagctgccgccacgccccaataatattcggaggtgcgggcggtttgggtgtagagtgtgttaattgcttggagtggttggtgcatgtgatcacgcatgacgcgcattgccatgccgttaactttagtggcaattaataaatagttgccgttcttgtcaagttccatagcatagcgaagtaagtcagcacgaacttgtgcgtcttgtttaacttcaggatcattataggcaacgtcgatttgttgcatcaaacgcttggctttatcatttttgttcacgttaatccccccatgccaagagtatagcacaagtctcagacttaaatgttagcttaacacgaaaccgccccgcatttcggatagtgaaatgcggggcggtttttatcagtccgcttgttttttacatgtgatttctgcaagtgatttttgatatgccctggtcgctaaattaacacggccgccatcacttgggccacatcttggctttgccaatactgatccactaatggtgcgaaagcgtggttcaagccctgatactgaataaacgtggttgcagtatcggcagcggccaggcgttgtgcataagcccaagcttgtggtcggaagggatcaaactcgccgaccataatcgtggttggtggtgtcattgtgaagtcttcctggtgtagcggtgagatgagtggagaatgtgaatcaaagttctccggaacataataatccgtcatgatgctgtcaagttgccgaaagaggtcgtgatagttggtgagaatggcacgctgtgagtcaataatcggaaaggcggccaaatcccagagtggaccggcgtggtcagcatttggggcggtaactgggtacaacagcagttgttgattgatacgattgctaccgagttgttgattcagatttgttgcggccatgatgacgttagcgccagccgaatcgccagcaacggtaatcattgtttcagcgtcacgttgttccaaatattggaaaatcgcgagcccgtctaaaataccagcgggtgctggtgcttctggcgctaagctgtaatcgacattaagaatctcgcagtgacttttagctgcgaccagctttaaaaggaccgtattattgccgggaacaccgccgtaaaaggcaccaccgtggaagtagaccagtactgtgtgattaatgacattttgtggtgtcagccattcaacgctgaccgtgcgattcagagccgtaatatttcgactttgaactgtaaccgcatcaccaacagggtccgcgatggcgggggttaaactaccactgcggagcgccgctagatcattttcaaggatggctggttgtttgaaggccgttagtgtttgaaggacgtgcgggtcaaattgttcaccggcgatgtcgttgttaaatggtttaacgattttgacgacgccgttgacggttgtttgaatcgaattaattgttggcatcatattcaacatcctccttaggttcaactttagccgctgcgtcggccttgttggcttgtaattctttttcgtctaaccgatagaattgcatcatgaaaatcatcgcggctaataaaataatcggcatccaaataaaagcgagattaataaatgtaatggttcgtccggactgtacagctgccttggcattgaattgtccccatgcgagaaattgaccggctagaaaaccgccaattcccattcctaatttggcgccaattattggtacggcagataagaatccggtttcatttaggcccagtactttcgttgagtagtcaacggtatctgatagcatcgcgaagacaatcgtgaacgtgatccccatcgcaatcaagaaaatgacggagccagcaattagtaggctcacactacgcatcttttcagcgattggcagcagtagttggccgataacgcccagtacgagtgaaaactgcaaaacgttacggttcttaaagcgttgtgataggaatggtacggacaggttcccgatgacggaaacaaagccaatccccaggaaaattggcgctaattcaggccgaccgtagacgtatttgataaagaagatcgctgaatttccccgtagcatccagaaggtttgtagcagaatgaatgagcaggctaataatagccatggtttgttgctagccgcacccttcaagctttgccagattgagagtgattcggctgactcagtggtaccgtctggattttgtgcaccgttagtttccttgagattgagaaaagcaaagatgaagagtcccatgataacgaggcctaagataatagcccagagggtgaaacctttcgactgattgcctttgccgagtaatttaaccattggcaaagtgatggccgccactgcactggtcccgatggttgtcatgaccatccgagcactcgctaacttggtccgctcaacgctatcatcagtcaagcttggtaaaatcgaagtaatgggcgtgttggcaccagaataaatcaggctaaagaaagtgtaagtgattgaaatgtagacgagtcgcattgtggtattgccgccaaatgatggaatcatgaatagcgacatggccagcaaccctaacggaatgccaaaccacacaaagtaggggcgcgattgtccatacttcgtgtgtgtatgatcaatcaaataaccataaatcaatgcatcaaacgcatcaatgaagcgcacgacgaagaacagcattcctgcaaaagcagctgagatgcccgcgaccgttgtgtaatagaacagtaagtaagtgctgaccatttgccaaataatattaccggccatgtcagtggaaccgtatgcaattcggcgtttccaagtttgaaaaattgacattataaatccccccaaacgaattaaacttaaactaacaatgataattaaccccttttatcaacataattatatttccaaattaggtgaattatcaaagataggcgatagtttggctggttaataatcgaaaggtgggtgcatcttttgtacaaacacgactgatgcctgttttgtagcgctggttgggagaaagccaaacaagcaaaaaacacccccagcaacggccaatcaaattagctgttgctgggggtgttaatggttaaagacgcgtgtcgcggatgtcaccaattgttaacagaaatagaattgaaaatagccttgtcggtcagttctgttttgaccattaatcaatggttggtttcagagctagtgctttagcggcttcttcactgtcatcaaagtgatgcttagtccggccgatgatttgataatcttcgtggcctttaccagcgattaaaacaacgtcgccgggttgtgctgcttcaatggccttggcgatggcaacgtggcggtcttcgtagacgggcacgtcggcgtttggcacgccggcaaccatgtcatttagaatcatggttgggtcttccgtccgaggattgtcagaagtaaagattggcttagtactatgttcgacagcaattttagccatctttggccgtttcgtcttgtcgcgatcaccaccacagccgacgacgcaataaatatccttagtcgcgaaatcctgaatcgtttctagggcattcaataagccgtccggagtgtgtgagtagtcaacgatgacactgacacccgtgtgggaaggaacggattggaagcggcccttaacgccggtaaccttctccagtgacttaatgatttggtcttcggggatgccactagcgtaagctgcggcgaaggccgccagcatgttgtacacgttgaactggccaatcagttgcatcgtcacgtgggttacgtggccgaagacggagaggtcaaattcagtcccgtggctcttgatttcaacattttgtgcgttgatcatggcatctggtttgagtccaaatgttagtacgtgcgctgccgtgtactgttcaaattcacggccaacgggatcatcggtgttcagaacagcgaccttattagttccgtcggcgctgtacttattgcccagttgtgcaaagagcatggccttggcttccgtgtacttagccattgttttgtggaaatccaaatggtcttgcgtcaagttcgtgaaaacggcgatgtcgtaatcaatcccccagacccgtccgagtacgagggcaattgaagaaacttccatggcgacagtttcaacaccggcatcccgcatggccgctagagtccgttgcgttgtgatggcgtcgggggtggtgttggcagttggcagtttttcatccttgattttgcgatacatggtcccaatcaggccggtggcttgctgctgatcacgatagatttgttcgatcaggtgggtgacagtggttttaccattggtacccgtcaccccaatcatccgcatcttttgactaggcgcaccgtagaaaacatcggcaagaattgccatagcgcgttcggtgttttcaacgtagatgaccggtacgttgacgtctaaaggttttgacgccacgatgatcttggccccttttccgatggcctgatcaacgaggtcgtgaccgtcgacgtgataaccaacgacggcaataaacatggcgccgggctgaacttcgcgggtatcctgcgtcagcatggtgacatcaaagtccgtggtcaaggcgggctgaacctgcttgaattttaaactattaattaattgacttgcttgcataatattagcgtccttttcaataaagttactgtttctagaatacatgcaaaccggataattgtcaccccaaatgagaattgaaattatgcttgtaatcgctcggtacatggtgtgctgctggttgaacgtgccatctccaggccaatctaggtcaacaaaaaagcccggcaattaagccggacttgcagggatggttattcgattcctaagaactcatcatgtaaggcgttcatggccgcttttaaatcggcttccttaacgagcacccagatggtcgtataactatcggtcgattgtaaaatatcgatatgttgtgcagctaatgccgagacgatccgagcagtgacgccgggtgtcccagtgataccagcaccgacaacggaaactttagcacagttcgcaattgactgacaatggacgtgcgcgtcagtcagtagttgcttggcaacgtccgcgtcaccatcaaccaggttgaagacaacttggtgtggtgtaatgttaataaagtcaacactcaaaccgtgctgtgccatcaattggaaaatggcacttgaacttaacgtatcggtaggaacagtaaattgcgtcaaatcagtttggtgtgcaatccctgtcacggtacgataatgttcgatttgggtcgtggtccggtcagtgactaaagttcctaattcgtcgggttcctgataagttgaccgaatccgcatcggcacgtgagcttgttctgcaatttcaacagcacgcggatgaatgaccttagcaccttcatgggccatgttagcgagttcttcgtagctgatggccttaatgaagcgggcgtgggtgacgagtcgtggatcggcagtcatcatgccgttgacatcagtaaaaatatcaacacgttttgcttttaaagcggcaccgaggatggctgctgatgtatcggaaccaccacggccaatcgtagtaatgtggccgctctcagtagcaccttgaaaaccagttacgactaccacgtcggcgtcaataaaggcgtccgtaattggtttcggatcaacgcggagaatcttcgcattttgaaaatcgtcgttagtcacgatgccagcatcatgaccagtcatggccgtgacgtttaggccttgcttacgcgctaactcggtaaagacagcggtcgagatggtttccccaactgagaccaacatgtcgagttctcgattggttaagcgggagtgctcggccccaactaatccgagtaatgagtcggtggcgtaaggggcacctttccggccaattgctgagacaacgacaatgactttatcgccctgatcgacggcgtattgaacgtgctttaaagcttgaatacgggcggcttcgtccttgactgacgtgccgccgaacttttgaacaataatttccattgacctaaaactcctcgactttttccgcaacagcgttagcttcggggctatccatcaagtggtcagattcgacatagagccggtgccacatcatgaaggtgaggaccgtccagagtttccgagaattatcccgaacgccggccttatggtcatctaagagtttcaagaagtagtccttgttgaagtattggtcagtttgcgaatcgttaatgatctgcttagcccagtcgtacatttcatctttgagccagaaccgaattggtactgggaaaccaagctttttacggtgaaggacgtgcgctggcacgatgtcttcgaccgctttacgaagaatgtactttgttgtgccgtgactaattcgaagatcagctggaatttcggctgctaagttatacacttcacggtcaacaaacggggtccgcagttccaaactgtgcgccatcgttgtccggtcggcgttatgcaacaagtcaccgtttaaccacgtgtgcatatcgatgaattgcatccgactgattggatcatagtcgacggattcatcatagagcggttgcgtgatggactggaacggatggttctgattgtaattcttgaagaaggcttgtttttcttgttcaccaaagataaaggcgttcccaacgtagcgattctctaatggggtggtccctcgtagtaagaatgaccgaccacgcattccctctggcatcatgagtgcgatacgcttcaaggcaccattaatcggtttcgtgtagcggaacggtttcaatgattctggttcatgatagatggtgtagccaccgaagagttcgtcagcgccttcaccagtcaaacaaaccttaacgtgcttgaccgcttctttggctaagaaatactgcggcacagcggccgggtcagccaacggatcatccatgctccacacaaagtgcgggaaggccttcatgaaggcttcaggcgtaatcgtcatgctgtaattcttaacaccaagcttttcagcggtctcttgagcaacgtcaagttcactatacccttcacgttcgaaaccaacggagatcgtttcaaggtttgggttgaagttttttgcaatcgcgacgatgattgatgagtcgatcccgcctgaaaggaaagaaccaactggtacatcggaacgcatgtgaatcttaacggagtcaattaaggcatctttgattttttgggcatactcgtcttcagaacgttcgaccggatggaattcacggtgataataccgatcaatccgtggtgcagaccccaactttttcgtcaaggagcaaccaggggcgagcattttgatttcttttgtgagtgtttctggttcaggaacaaattggaacgtcatgtaatcttgtaaggcatttttatcgaaggttttatcctttaaaatcttgtaaatggccttgctttcagaagcataatagaagtcatcaccactgatagcgtaatagaacggcttgatcccgaactgatcgcgcgcggcaaataacgttttttcttgtttatcccagatgacgaaagcaaacattccccgtaagtacttcgttgcgtcagcgtggtacttggcgtacatcgcaagaattacttcagaatcggagcttgttttgaattcatagccttcttgtttgagttgttcacgtaattcaacgtagttataaatttccccgttaaatgtcatccagtaacgttcattatcataagatagtggttggtgaccaccggctaagtcaatgatacttaagcgccgaaaacccatggtaatgttgtcatcagcaaaataaccgtcatcatcgggtccccgatggacaatcattttagtcatttcgtggatggtctgatcgtaagctgcgttatccgctttagtccgatcagttaagcaaccagcaaaaccgcacatgtctgttcatctctcaatctttaaagtttagacagttcttatctactatatgtgtacagatggttcgttgttaatttacccgtttcattcacggatgtaaagcactctgaacaattataacggtttcttaccaatgtctgtcataattatgcttgacaatccgcgacgtacactttgactattatacttgctttaattcataagataaagcggagcgcgcagatggaacgctttcattgataaaaatttcatattgcgcgaaacgtccaattagttggatgccggttccttggcggagcggatttctactgactatttggttagttcgaattgaccgttattgacatgacacatttaggtgctgattgctggccttatggctgaaaaagtcacagaaaaatcccgcaaactcatgcacaaatttgcgggacgtttaagtgggaatattaaattagatgtgcccttgcgctctaagcccagccaactaggcgcaatacggccatggcaacgatgcctgttataacgacggctagtaaacttttggtgagcactcctgcaagaatggcaggaattgaggcataaatatttgggagattaaattctggccagtgtcccgcatggtaggtgagcagactttcaacaaaaatagcggtcataatggcaattggcacaaatgataaaaagctgattagccattgggggactgacagatttttaatgatggcaaacgggacaatgcgtgatagccaagtcacgaggccgcagagtaagatggtcacaaaaatgtaagtactcatttatggtccaccaccattccaaaaccgcaaccgagtagcgtcgcaaagatcaaagccaagttgcccggaacccaacgcatgagaaaatacatggcgagggccacaaatagtacgacccacaactgggtcggcaatgatttactgcgatccgtgatgatctgcaagtaaagtaaaccaatgaacataccaacaacggcgaaatccaagccgaactggttagggtcagtaatcaagttacctaaaaggcaccccaccactgtcgcggctgcccaaaccaagtaagccacaatgttagcagcgtgtaaccaactcgtttttaattgttgattggtctgattgagcttgttcatgctgagcgcgaaggtctcatcagttagtaacgatcccagtccgatattttgcaataacgactcttttttgaaatattgagcgactgacatgctcattaaaatcatgcgtgaattaatcaaaaaagtggataagacgattgccgaaatcggactacctgctaggagcatactgacgataataaattgtgcggaaccagcatagacgattagtgacatgagtagaacggcccaaactgataggtgactcgtgttggcgacaatgcccattgctaggccaacgccaatgtatccaaagacggtgggaatgacatctttgatgcccgcgcgaaaggttaaactagaatccataaatgtacgacctccgattcaataagtatgcgttaaccaacactaaatgggattatctgacaattagtgtggttcatgaaacaggataactatgtaggttaagtttgagtgcgtgttatgatgaaaaagcacgcttgatatccgccaatagtaaggtgacgaatgaggcaaaggcgggttaagaattagtttactactttcggtgaaaataatgaagaaaattatcattgacttttaatcgtgacgttacgaaattgttgcttgcatttcaaaagctgggggcgtaacataatcacattgattttttgaaaggacaaatggtgagagaaaatgactctggaacaattagcagcccatagcggggtcgctgctgataaaatcgtcgcctataccaatgccgggttattaccttgcaaggatgtcaacgcgcattttagcgccgatgatgaatattggctagatatggtcaattgcttcttagaaaatggctcatccgtcgaggatttgaaagatttaatgccactttgtgaacagtgtgcagctcaataaataagtaagttaagacaatcgcaccgattctactagaattggtgcgattgtttttttattactcatcgttattaaacaatcatgattaaaccgtgccgattcttaagttcaaaagcagccagcttagacccgctgggaaaagttcaagttagcgtaaatatgcttagattggttcgtcctacatcgacctccaggcatttctgccaattgccggaacgtggtgggcacagatttgagccgaaaaaccacgtctcaaatactggcctttcaccactgggcattgtcaaaaatgccttccagtcgggatagtattcgaatggcagacggtgaggtacccaacttttgatgaattggtcgttgcttttcataaacggtaattttgtcaatcaactgtcagactaaaaataatattgagatggctcactaatcctgaatcggtgtagtaggatttaatctcttgacagagtgcttaatgcacctagcgctttgtttaaacttccagcatcaaaatagtcagcgactaattgtaccaaattaggtggtcgttcatcagccattcgagcggtttcccgaccggaggggctgggtgacaatgctcagtagccaaattattcttagtcggaagtgggttgcttccggcttagaataagactcgtatttgagatgacgcgggttatgcgttagctcaaatcgacgtcggcttacgttccagcaattgtcacccagccccggaggtcgacataggacgcgcaccggctgacgaacaggaatccacctaatcggcacggtttaatcataattagtcctgattggtgttttggagcggacactattttttaaatgttcaatcggaatataaattaatttatatgggctagcaggattgagggactaacggtatacttattgaagcataaataccaaccaaaaaggatagtgaagcagggatgaaatcggggaagcaccgggtatcattattgatactgttatgtttgatggtggtcggtttagctggctgccataacaaggcgtattcgcagtcaatcgagaaggggttaaatgcggttgctgagaataaataccaaaaagcgctgacgtattttgataacgcgctagcgcagaagcccaaggatgaaaaggcacaggcgtaccgggatcaaacgcaggcctacttgacgaccacatcggagttgaaggccggaaaagttaaaacggcgctgacgacggttgataagggtgtcaagattacgaacggggcaacaagtttgacgaataagctgaaacagttgaaagtcaccgtaaccagtgattatcaggaatatcagcaattgtcagatgatgttaaagcacagttaaaggtgaagaacggcaactattcagcggacgtgctcaaacgttgcgcagccatcaactgggataaaaagccatatttgaaaccgttgaaggctaaggtaaaacagttattgactgcggcaaaaaaggccaagacgaatatgaaagttagtgcggctgaagcgaaacgagcagcggcgttacgtcggaagattgctgccgctaaaaacaagtggaacatggccgcattagacgatgtgcccgattggttcattttggcactttttgccgacgatagtgatgtggatgatgctgctgaagaattagatgacgaatatgccgatcaggccgacgataatgacgattattcggatcgggatgagcaaacgactgattcgaatgatgacacgaacgacaccgacgcggattcggctgatgacgattggagtgatcaagatacggattcgaatgacgataccgacgatgattccgatactaatagcgatgctgacagcgattcggattactcagaagatgatgacgatgaagattcgaatcgtgatgacgccgatgacagcgaaacccaatccgatgacgattacgatgatgatactgatagtgagtctgatgacgacgattatgatactgatgatcaatatgacgatgatgatgactacgatgacgccgagagcctactcaacccggcacctgttcaaccgtcagtggccgaccggctgtttgcgtcggctagttgttagtcgttcagcggtaaaatcaccaaagatcgtctgacagttttaataatgcagttatgggcgatataaaaacaagcgtccgcgttgattagatcaacgcggacgcttgttttcttacgtggagtttgttgccgaacatgtctgagtaccagttgctcacgggcaagcctttatcttagcgttgattaaggctgatgtttaaagcgagcgtaaatcgagctcattgttgaaaatccgatgactattaagaccatgatttgtaatacgccagtgggttgctgaatttgcctgacgataatgtaagtcagaatagccaagttgatcagccaaccaaatcgtcttatttgcttaattataaaatttttagggtctgttttactaagcatataaagtaaaagggcgatgatgatccaaaacaatcctgatgttgagtgatagtacacgtaatcattcctttagacgtctgactttctaatgacatcgtaacaatcaacttggtacgtgataatcgtatcatttgctcgaaagcatcaaaatcatgttttagtaaagatagtgtacattttcagaaaagaaacgtgaattttttgtaaaccaccggcataattaaccggcgcatcgattttgaataagtgtggtcttgacgctggggcgccggcgctagttttggcaagacgttagtgaaagggggggacaagccatgatgatctttagacaacaaagaccccggcatgccggggtcttgtcagctatttttaattgttagttcaagttatttgctagctttaacggttttaagcatgctctgaatggcattggcttgatattgagcagccgctgctttttgaacttttgcgagttgcgctttgctcattgtcgggttcttgaccattgcggccttgacctgattagtcacgtagactttagcacgcgcttttaatgtcgcttgctgttgcttcatcaatttactgaattgtttagcttgggttgtgctaagtacgacccagttcttattgatatagaagtagttggttcgcttgatcaactgtttgtcattgttggctaagccaaaccagaacttcatggcgttactcttataagtccaccgtgtcgtcttagtaactaactcaggtgtcgcggtcgtcgtcttaacttggttagcagtcttgacgctggctgtcgtatggctaacttttttctgattagtggtctttttataaatatagacccggtgcttgtcagcggtacccacactttgatagagcaataaatcaagttgcttgctactaccagcagactttaatgattgcgtggtggtcgtcgttgttttgaccatcccgtaatgttgaccatcattcttggagacgaagacgatcgaggtcactaagagtgccgcaaagataacggataggttgattcgtaacgtgttttggtgaacgtagataaatgataagaagagcgcgattgcgctaacaacgagtagtacgagaatcattagtcgttcacctccttagtgttcattactggcttaacggaatgctgcttgcctttcatgaagaacgcgacgacgagcccgacaactgagaagcccacggcaacccagaaagccgcgtggtaaccatttaaggttgcgttgaaatagctgttctgataaccaagtggattgctcttaatcaagctatgagctggttttgtggcgtccgtaacgtttgataagacggaagtcaagatggcagtcccaatggaactagcgatttgacgcgtcgtgttgttaacggcagtcccatgacccattagttcaacgggaagggcgttcatcccagcggtagttgccggcatcatgaccatggcaatcccaaacatccgaacggcatagagaaccacgatgtaaaccgttgcggtattacgagtaatgaaggcaaatggaatggtcccgattgtcagtaaaaacatccctaaaattgccaagcgtttggcaccaaaacggtcaaaggcccggccggtaattggactcataacccccatcattagggcaccagctaatagtgatagcccagattcaaaggcggagaaaccatgaataatttgcaggtaaagtggaataaccatttcggcccctaccatggccatgttagcaactgagctcaaaatagctgcaattgtgaactcggcatgcttgaagacccgtaattggaggaatggattttccatcgtcaattgacgccaaataaaaccaatgatgaagataacaccaataattaaagttgagagaaccacggttgacgtccagccattgtcaccaacggatgaaaagccgtatagtaagctcccaaaaccaatggtagaaagtaccaaggatgcaaagtctaattttggcttagacgtttccaagacgttggccatgaagaagaagccagcgattagaacgattgcgacgattggaacgatcaaaccaaataaatcacgccatgataagttgtcgataacccacccagataaggttggaccgatggctggggccaaaccgataacaattccggcagtccccatggcagccccacgcttatcagcagggaagatagatagcataatcgtttgaagtaatggcatggtgaccccgaccccaacggcttggatcaaacgcccagccaataagaagccaaagtttggtgctgtccaacagataatagtacccacttcgaaaatggccattgcggaaagatataaccatttagtggaaatccgtgaacttaaccacgcactaacgggaatcataatcccgttgactaacataaacccggttgttaaccattgcacggtcgacgttgtgatgtcgaaatctttcatcaacgttgggaaggcagtggttaaaatcgtttgattaagaacggtacaaaaagtaccaactaataaaactgcaatgagcaagccacggttataaggcttcccatgtgtatcaacaggagttgacaagtaaatcccttctctctaaaaaagtacgttgtctaatataatcggatttatcgactttgtcaacaaacttgacattaatattaaaaataatatactgagtattgaaaatgttagaaaagaggttgacccgtggataagcaagaagacggtgtattttttaagaaatttaaagaacagctgggtaagcatcaattcacaatcggaattagcgatttggcgaagatgaccggcgtctctcagacacagctacgttactgggaacagaaaaattatattcatagtcttaaagtgagtgagaagaataccacgcatcgttattcgtatggtatgctgatgcgtgttcattttatcaagatgatgttagacgagggttttacactggcagcggctgtcgagcgggccgatgggtataataaccaaatggaaatgatgcgcatctttatgatgaccgcttttcaaggaatcgaagaacgggatggtcaccacatggtcaagttgggatattttgacgaagcgaagacacaacagctttattgttatattcaagatgagacgccacattatcgactttatcccgttaagtcagagcgctagcaaccttcagcttgtgtaaccgattaattaatgttaaatttaagttggtaaatgtcggtaagtcacttgggcatttaagtttcccgttcgtcaaccgatcttatggctgggttgaccgttgtcatgttggtcgtgttttgaagtttaactttgcaaaaggatttacaacggagcgcgaataagcgctgagagatgcctagctagaactaggtagtaatcgtgcataaaacaacgtgtaattgaaactagtagtagtcttcaatcgcccggtgatgatatttaccagaggtcccaagtgctgcgggaaagcttggggcttttttgtactttcgtacgttaaaacgtaatctatcagatcagtgtggttatcaacaaaaaagagaccgagtatcaactcaatctctttcaataatctataagtacgcgtggtgcttgtctttcatttagtattaattctacttctatatgaaataatcacgagtagcgcgcgttaattaagtaggaattgttaagatgtcgcagtttgagcaaacttggcggctaaccattcattccatggtagtgctggattaccactagtaaagtattgttgatcgagtcgatcaatcaagttgacgtaggcggtaaatgaaaaactaacggtatcactcaagcgttgagccttggtcatgtagcggccgtaagtaaggtgctcattgatgtctgtcatatagctggcaacatcatagttggacatcatttcaaggttgttagcgtcaaaaagtggtaagtagaatgcggcaaagtcttcaactgccttgtgctgcaaagaactatccaattgcgtaattgataattgagcatcatcattcacgatgcggttcctccttagttgaacaagcacgtttctaaattagtaaccaaattggttattttgcgctacaattaattatgtcacgattaggcaattatttcaaagctttgtcgttattagagactagaactggtgtctcaattgtagtaagatgttagaattatattagagagaatcagaagtaactatttagttgaggtgaagaatattcatgacccccatgaaggaagattacttaaaaattattttcgagcttggtggtacgaaaaaaaaggtgtcgaataagcaaattgccttaagcttagacatcgcggccggctctgtaacggagatggtcggtaaattagttcaggaaggcttggctaagcataccccgtatgctgggatttcgttaacaaagaaaggcattcgctacgctgaaacgttagttcgcaagcaccgaatctgggaagatttcttagttgataaattggattatgatttgccagacgtgcatacggaagcggaagtgctggagcatgtgaccagtgaacgactagtggattctttggaagcctttttaggcaatccgacgcattgtccgcatggtggcgcgattcccgataaggatggtcattatcaggaagacagtcatgtgagtttagcagatacgcaggatggcacaacggttacgattgagcgatttattgataatcatgatttattagtttatttgcatgatacaccgctcaagattggacagcaggtcacggttttaaagcacgatccatttgaaggccctgttaccgtttccattcagaaaacgggcgaggaaatcccagttagctataaagcggcgcacaatgtctttgtaaagtaagcatgcggcgcctatttccgaacaaacctgttaattgttagttagttattctgtttcatttatcatcacataaacatttcatggaaatcatggtgtttggctaccctttttagaaacaatatgctacaattgttcttgtagcttggttaggtaattttggtcagatcgtttcaataaactatccccatttgtaccgaatcatgatttacattattttatacgtgcaaaatgcactaggaggattttttattatggaacacggaacagttaaatggttcaacgctgataagggttttggttttatcactcgcgaaaacggtagcgatgtattcgtacatttctcagctatccaagaagacggcttcaagagtcttgatgaaggccaagctgtaaacttcgacgttgaagaaagcgatcgtggcccacaagcagttaacgttacaaaagcataattaacagcttaaatggcttaaaccggtgatgagaattaattctcatcaccggttttttgtcgttttgcagcggatgcttaattatcataaataaagctttactaacagccagacattggctaaagtaagaattattagagaatgtaattctgattattaaagggtgggatgacagtgacaaccgatgagatgattattgcgacttgcttgaaggctggtaaaatcatggtcgagaatggttcggagatttcgcgagtagatgatacgatgatgcggattgctcagaatgcgggggttgttgctgccaatacctacgtgacgattacgggtgtcatgatgtcgattcaaggacgtaatgcaacgcagattgccgcggttaaccagcgaacgatcgatcttgaaaaagtggcacaggtcaatcagttatcccgtgaatttgcggctacgaccattgatttaccaactttatatcaacggcttaatcagttagatgcagcttcgcgctcatttccgttgtggttgcagttggtcggtgcagccttagtcagtggccccttgatgattatgtttcgtcaggaaattgttaatacgtggccaactgttattattggaacattaggttacttggtcttttatctgcttaaccggtatcttaaaattaaatttttgagcgagttaacggcggcacttctaattgggtttggcgcggaatgggtgtgtcagattgggtggggaaccaatgtcaatgatattattatcgggtcgttgatgccactagtgcccggagtgccattaacaaacgccgtacgagatactctggctggtaatttcgtcagtgggcctgcacgtggcgtggaagcgatgctgagtgcggcagcactaggctttgggatcgccgttgtcattacattattttaagtacgggcactagcctgggtattcggagggatcatgatgggcacaattggacaattagtgctggcttacattgcggtactggggtttggcctgattattaatattccgcatcaagcgttaaacgttgcgggctggattggtaccctaacgtggggtggctatttgattgttcaggcttttgatggtggggtcgtcttaggaagcttaattggctcggtcggtattggcgtcctcagcagcttagcagctcgctacaagaagatgcccgctattatcttcaatattccgagtttagtttcattcgtgcccggcagtcaggcttatcagatggtgcgtaactttgcgctgggtaattatcgtgaggcggtttcattcacgttgcaagtgattatgattactggtgcgattgcattgggattcttattagctgaattactcaaccggcttatcgcattttgtattcgccagtggcggttgcaccgattggagtcgtaacctaactgttggctgattagttgtgaatcgtgaacaaagtttgcggacgctaagactaagcgccataaataaattccgccaaaagtggtgggttagtgcgactaatttgccgtgtgccagcgttctgaatagttacgcgcttagattagttattacgactcgcattcaatacagaaaaagcgccaactgaactgctctactaagcagttcagttggcgctttttaattagttagctgagacatcgcaacaagtagtcacgactcttatcatcaaatcagatggttagttttggttagcaaatttttcgccggttgtcgcagcctttaaattaagggacttacgtaagacgttcgtgacccgttgcttttcagattgcgaaacaacttcgaaagactgaccatcaatcatcttaccagtaccctgggcgtgatcagagacgatattcttggttgcactacggtaattagtgacgatactagttaaattaccgaatgttaagtcagtccgtgtttgtttagcaagtgaatttaagaaatcttgtttaagcaagttggaagcactggcgctttctccgataatggcggtgattaattgccgttgccgctgttgccgaccatagtcgccgagtggatcatcataacgcatccgggaataggccaaggctttggcaccattcatatgttctttttggcccttagtaaaggtgtaaccttcgtaggtaaatgtccgaattggagtaatgtcaacgccaccgatttcatccacaacttttttcatgccacccatgttgatcagggcgtaatagtcgattggaacgttcaaccatttttgaacggtcttgatggtcgttccggcactaccataagcgtaggcagcgtttaacttagtcgggaagtcctgttcgaaaccggagacagccacttcagaatcacgtggtaaactcatcagggtcgttgtcttagtcttggggttgatcgttgctaagatgatcgtatcggtccggcctttatagttccgcccgagagccccggtatcagttccgagtaataggatcgagacgggtttcttgccattcaatacggcgctcgtattccgactctttttaataccactactcttgaagacggtgtcggccgcattcttggcgttaaaataagttcgcgcggcaaaggccccggtcccaactaataacacggcaataatgattaaaacggtattgcgaacggggtgcttcttcttgggcccgttgccgttcccctgtgaattgtttccttgtgatttctcacgatgcatttctgagcgacttggcatgtcttccatgaactcttcctccaatggtaatagttattcatagtttagcattttttcgggtcagcgggaactgaatccacgtaagatttagcttgattaccgatgactgtcagataaatcataacctttttgttaataaaacgtgattaaaatgggaattctttgtttttttttaatgttccctgagagatattaatgattcgttcagtcgattaatagactatggtataattttgttaattttaatattaaatgggggttcttgttttgatgatcgataagtcgcgtagtcggccgatcaagtttgtcattggggtaattttatttgcctacttaagctattttattagtgacggcgcggttggtattgatttactagatgtggccttaacgtcgctggtccaaattagtaatagcggtatttggacggtattttataaggtgattgcttggttggcgtcacccggaatggacattttgtggatcgtcatcctggcgtttctaatgtacggatttaaatataagattcaagcgttctggacgctagcatatatggttggtgcaatggcgttaggctttattgtcaagcacatcatcggccgagcgcgaccaattggtcatttagcgcaggataccggatatagttatcccagtggtcacgttttaggaaccttcgtgttggtcagcgtgattatcatgttgattgttcctgagttgccaagttatcgaatggcaatgatcgtcaagtgggtgagtgtcgtatggttagtattggtcattttctcacgtatttacttgaatgcacattatccaactgatacgattggggccgtgctattggcatggtcttggagtcaaatcatgcaatggttctacgttttctgggcaccaggattattgaaatggccgttgttttatcgctcatatttataaagacaattaacaaacttaaactaatctattatttagcaggcaaccgtgtcactaaataatagactcaaaataaaaaatcgtttgctttaatcgacactactcggctgattgcgagaaattgatcgaagcaaacgattttttgtttacagctataaaatattaactagcaacgactggtaatgaactaacgattatcagctagccattcaagtgctaacgttaaccagtgggcgacgtgcggctgattggcgtctggtttccatgctgtttgtgcattcgcaagggctagtccgtgtgggccatgtttaaagacgtgtagttcataaggaatcttagcagttgctaacgcagtcgcgtaggcaagcgtattggttgctggaacaattgggtcgtcagccgttgtccagataaaagtcggctgattatctgaatttacgtgttggtcagcggccagttcgttcggcgttggtgtccaggtagccaaggtcgcgtcatccttgggaaaacctagcaatggactgatgactggatagccgagtaccacgttattcggctttaacatggcgggcgttacgtttaattcagttgccacgcgggtcgcccagtaatcgttatacagtgccacaatgtgaccacccacgctaaaaccagcaggcgtgatctgttgcggatcaatatgccattcggccgcgtgttgacgaagcaagttgactgctcgtcctaaatctaatacgggtgctaatccgagtggttgttgatcagtgagtagcgtatattccaagtaaaaggcctggtaaccgtgcccagcgaaagccatggcgagactctctgcttgcgccactggaatatgcgtgtatgagccgcccggaacgataataatggcgggtaagttcgtttggtgtgcgttcgtatccggttgatgcaaataaccggtcaattgcgcgcacgtcgctgttaatttttgcttaataacttgcatgcaatcacctcaatttgatatggttaacataactattataacgcaagtcaggtggaacagatatgggcatggttacggttacaactcggaatgagcaactcgagttacggccatttacgttggcagatgcagaggattattatgacttagttcgtgatccgtcaattgcggcatcggcgggctttacgccagcgcacagcttagtggaagccgaattcttattgaaacaacaagcgaagttaccacagatttttgcgattgaactaacagcgatccaccgcgtgattggcagtgtggggttgtatgagcgcatgacgaatatgggcgaaccagcaactttagagatggatctcgggtatatgttgaacgctcgatattgggggcggggcattatgacggcagcagttgcacgtattttacgatacgggtttgaaacgcttcatttgcggcggatcacagccagttgtctagctaataatccggcgtctaagcgaatcttagagcatgctaattttcgacagtatgatgctgttcgccatccagattacgccccgtttggcgctggtcagacggagttattctttgattgtgtggaattaaacctttaggagatgagttaatgcaactcgcaaaatcgtttgaacaggccgcctgcgtgttggtattgttggctacacagcaaccggagattccgttgactgcggatgtcttgcacgagcgaattggtggttccgcttcgtatattcgtaagattattcgtaaattagtagtggcaggactggtcacgtctaccagtggaaataacgggggtgtccacttggcacgctcacctgaggatatttcaattacagatgtggtcgcggccatcgaggggacgttgcagacctttccgaattatggttattttgaccgagtatttaaggacgttgaaccggtcgctcacgaagggacgaaagtggtcaacgggattttttcgcgagcggatcaattatggttagattttttagaccagcaaaaactggcgacattgatcaaggaattattagttgttactcaaatcccagtgctggattggacgaattattcagatgataaaatggcccaattaaatgcgctgcttagtcggatgcgggcacataagtgagacgtcgtacaaactcgataaaaattgggagcggtttcgcttggtaaaccaatattgacgcgcttttgccaatcggggatcattttcaaaatgatacactttatttcacaaggctgaaaatgctgttattaaagcgttttttatggtattctaacaatgaatttcacaagatagaggggaacaacatgccagataagaaatattacggggccgatgcgatcgtcgacagccttgtaaaccacgacgttaagtacgtattcgggattccaggcgctaagatcgatcgggtctttgagcgcttggagcacccagtcaacccgaaaagtccgcggttgatcgtgacgcggcatgaacagaatgccgcgtttatcgctgccggaatcggtcggattactgggaaacctggtgtagtgatgacaacatctggccccggtgccagcaatttagccacggggctcgtaacggcaactgctgaaggtgacccagtcttggcaatttctggtcaagttcagcgtgctgacttgttacggttgacccaccaaagtatgaataacgcggcactatttaagccgattacaaagtacagtgcggaagttcaagaaccggaaaacatttcggaagtgctcgcaaacgcctaccaagaagccacagctgctaagcagggtgccagctttgtcagtgtgccgcaagatgtcactgattcgattgtacgcacacctgttattacaccaatccaggcacctaagttaggtcctgctagcccggtcgaagccacgttattagcacaaaaaatcaaagcagctaagttgccggtcttgctagttgggatgcgggcttcttcaccagaagtgacgaaagcaattcggaacttggtggctgctgctaatctaccagttgtcgagactttccaagcggccggcgtgatttcacgtgatttggaagccaaccatttcttcggtcgggtcgggttattccgtaaccaaccgggggacatgttactaaagaagtccgacttagtgattgcggttggttatgacccgattgaatatgaaccccgcaactggaatgcggaaggcaaatcccgtatcgtggttatcgatgcaatgcgcgctgaaattgatcataattttcaaccggaaaccgaattgatcggtgatattgcccagacgttagactttttgttgccgtacatgaagggctatgatattagcgatagtgcgcgagcttacttgggtgaattacaagaacggcttcagacgcgtgatttcgtacctaatattgataagcagtccaagttaaatcatccgctgtcagtaattgcagccttacaacaacgggtcagtgatgacatgacagtgacggtcgatgtcggcagtcattatatctggatggcgcgtcactttcggagctatgaaccacggcacttgttgttcagtaatgggatgcaaacgctaggagtggccttaccttgggcaatcgcagcggctttggttcgtccagatacgcaaatcgtatctgtctctggtgatggtggtttcctattttccgcccaagagctggaaacggctgttcgactgaagcaaaatatcgttcatttgatctggaatgatggcacctacgatatggttaaattccaagaagaaatgaagtatggcgaggatgcagcggtccactttggcccagttgattttgtgaagtatgctgaaagctttggggcgactggcttgcgggtaaaccaacctgctgatttggaaaaagtgcttgatcaggcctttgccacggatggtccagttgtggtggatattccaattgattattctgataacaaagcgttaggtaagacaatgttaccagaccagttttattaaaattaacattagtgaccggttgtcaaaagatggtcggtcagatataatgattgagtatatcgaaagaagaggatgcggttaacaatagtagccggctggaagtgggtcaccacttatgaaggtcagtgaacggggcaaccgccgaaatcgatggatcagtgaccgattcatccgttgggccttggttgaataaatcaaggactgtcgcagctagaatagttgcggggcgctatcgacgatgaaatcagcaattatgtcaatcaatctgattaaagtctttttgcgcacgttatcgtgaggcaaagaggctttttattttgattgtgctaacctgaatcggtgtgaacacttttagatataaatcgatttttggaggttctgcaatggcagaaaaacaacatcaggaagtgcatcgttccttacagacgcggcatttatccatgattgcattaggtggtagtatcgggaccgggctgtttgtcgcgtccggttcggcaatttcaacggctgggccagggggagcattactggcctacgttggtattggagtgatggtttactttttaatgactagtctgggcgaaatggcaacttatttgcccgtttcaggttcgttttccacgtatgccacgaagtttgttgacccggcacttgggtttgcgatgggctggaattactggttcaactgggcaatcacgttagcggtcgatattagtacggcggcgattgtcatgcagttctggttgccatccgtgccggggtgggtttttagtctgattgcgctcgtcttgatttttacgatcaacgcgctgtcagtccggtcgtttggagaaactgagtactggctttcgctaattaaagtggtgaccgtgctcgtattcttggttatcggtgtcttgacgatcgtgggaatcatgggcggtcatgccactggcctcagtaactttacctataaaaaggcaccatttgttggtggaattccaacgattttgagtgtcttcgtggtcgctggtttttcgtttcaaggaaccgaattaattgggatcacggccggggagtcagcaacaccagagaaaagtattccggcggctattaaacaagttttctggcgtattttgttattttacattttagccattttcgtgattgcggcgattattccttatacgtcgaaagatcttctagggtcatcagcgagcgatattgccatcagtccgttcacgttagtctttaaacgggctgggttggcggctgcggccagtgtgatgaacgcagtgatcttgacgtccgtattgtcagctgctaattcggggatgtacgcctcgacacggatgttatattctttgtcattacagggttatgcccccaagacatttggtcgggtcaatcgtcgtgggattccaatcatggcattattaggaacgacggtgattggattactcacgttcttgtcgagtctattcggtgaacggatttatattttcctcgtttcggccagtgggttaacgggttttatcgcttggctaggaatcgctatttcgcatctgcgtttccgtcgcgcgtttgttaagcaggggcatcaattgagtgaattgcggtaccatgccaagtggttcccatttggcccgtggttcgcctttatcttgtgtgtcgtggtcattattggtcaagacttacattcatttgcaacgcttgattggcaggctattggggtgacctatatgagcatcccgttattcatcatcttgtatgtctattataagattcgctatcatactaagatgattccgctagacaaggttgatttgacacgcaaacgacaccatcaagattaagcacgcactttgatagtttgattaaatgcggttgacactgggtcaatcgcattttttgacggcgagagttggacctgtcaactcaaggcgcggtcgtatttttaggtgtcctgatttatgctgataacactgctcgcaacagatggtcacggcggatcgttatgagtgggggcttgcacgattgtaatgatagcaagcggcaaattgagggtgcgctaatctgatatctatggtaatttgatagaatgagaatatggaatcattaaaaattcgcaaacttatccttaagaataggctagtcggctatgactatgctaagctgaaatgagaaaggcagcgagagagatgttaaagagaaatttgttaagaggtctagcattagtgtcattagcaggtgtcctggctggctgtggtgctagccagttgacgtctaaagcgactagtagttctacgagtgctaagtcgacgaagacgcagaccaagcggcaacgactgattagtgccttaccgaaaggcgttaaatcgaccgatagcgacttagtggtcgtcaataagtggcataagcgcgctgagatgacatttaataagtcgagcgtggatggtattgaagtccgtagttctatcgtcaaaccattggaagcctttctagcgggggcaaaaaaagccggctatccagcaacaatcgtgtctgggtatcgttcagtcgcttatcaaaaagaggtttgggatcagtcgattcaaacctatgagaatcaaggaaaatcagccaaggaagccttaaagctgactaaagaatatgtcgcagttcctagtggtagtgagcatgaaactggtctcgcagcagatatcatgaacacgcactggtacagcactcatggtaatcaattattgtcatcatccgacaagaacaagggtcagcagtggttgattaatcacgcggcggactatggatttgtgttgcgctttactaaagatggtaagcagtcgactgggattgactatgaatcttggcatttccgttacgttggtaaggcgagtgcggaattcatgactaagcacaatttgactctcgaacagtacgtcagtttgctgcaagctcgagaaaaggcggccaagtaataagctagccgtattattgatggccccaattaataccatttatggcgtacgttaggaattagctagcgtgcgcttttaaattgtcttcggtttagcaatgtgggttcgtctcaactgagtattatttggtcacgacagattatgctggtcagaggccgcactcaaagctgaagtgccaccagcgccggcttgggtagtaacccagtgtgtgttagtgagttgcttggatcgctgactagtgcgtcgcagttgtggctggtgcgaagttttttactgaattgactcaccagatattgcattttaagacgtgggtgcgtacaatatgtagtgttgcttttagagataatcaaaattttgacgtgattaaaaggagagacgccccatgcttgtaatgtcaggaacaatcggtgccggcaagacgagtttaacgcagttagtggctaaccactttggttctaaagcgttttacgagtcagttgatgataatcccattttgccgttattttataaggatcctaagaagtacgccttcttattacaaatctattttttaaataaacggttagacagtattaaatcagcttttgctaacgatctggacgtcttagaccggtcgatttttgaagattcattattatttcatttgaatggtgatcttggccgggcgacgaataccgaagttgacatttatgattcattattagataacatgatgcaggaattgccagaagcgtctcatcaaaagagtcctgatttacttattcatatcaatatttcttttgatacgatgctcaaacgaatccaaaagcggggccgttcttacgaacaaattgatcaagatcctgatttatataaatattatcagactttgaatgaacgctatgacgactggtacgctaattatgatcatagcccgaagatgcagatcgacggggatcagctggactttgtcgccgatgcggatgcgcgtaaggaagtcattcggttgatcgacgaaaaagtggctagtttaggctagttgcctttttagaatcaatgttttatagtagacagtgaatattaaacacggcgcgtttttaagtagacgttcagagaaccggtgggtggtgtgaatcggtagtcgaaactccggcgcgacaatgtgggcaggtaatactgcacggcacggccgttatccgtttaagggtgggattaatcatgatcctgaacttgggtggtaccgcgaatcgcagtctcttcgtcccaattgggaggagagactgtttttatttacgattaaaagtgaaaaggagacgtcgttatgttagatgttaaaatgattcgtcaaaatccagattttgtaaaagaacagcttggtcatcggggtgttgctgcgagtgacatcgatgatttattggccgctgatgaaaagcgtcgtgaattgatcgccaagagcgaacaattgaagtcgacgcgtaaccaagtttcaggcgaaatttcacagaagaagcggaacaaggaagacgctagtgccgaaattgcagaaatgcaaaaagttagcgccgatgtgaagacgttggatgaagaacggcggacagttgatgcccaagttcaggatatggctgcacatttaccaaacatgccccatcccgacgtaccagttagcttgaaagaagaagatgccgttgaattacgtcgaatcgggacaccacggcattttgactttacgccgaaagcacattgggatatcggtgaagatttaggcatcttagactttgagcgcggtgctaaggtttctggtagtcgtttcttatactacgtgggcgatggtgctaaactggaacgcgccgtttacaactttttcttagaccagcacgaagctgaagggtatacggaagttttgccgccatacatggtcactgatgaatctatgtacggtaccggccaatttcctaagttcaaggaagacgctttccggattacgacgcaagatttgacgttgattccaacggccgaggtgccattagtcaactattatcgtgatgaagttattcccgccgaaaaattaccagtttactttacggccttatcaccagccttccgtgaagaagctggtagtgctggtcgtgatacgaaaggcttgattcgcttacaccaattcaataaggttgaaatggttaagttcacgaaaccagaagattcatgggatgaattagagaagttgaccaacaatgccgaatcattgctaaagaaacttgggttaccatatcacgttattacgttaacgactggtgacatgagcttcacagctgccatgacacatgacttggaagtttggttcccagaacaagacaagtaccgggaaatctcgagttgttcaaattgtactgatttccaagctcggcgggcgcacattcaatatcgcgatgacgatggcaaattgcaattcgttcatactttgaacgggagtggcttagctgtcggtcggaccgttgcagctattttggaaaactatcaaaatgaagatgggacggttacgattccagatgtattagttccatatatgcacggtaagacgaagattgaaaaacaaggttaattgagatgaagttagcgaactcgcagtgatgcgagttcgctttttttgcataattaatgagtattaaggggaactgtcgattttaaaatgtgagtggaaataacggccgagttgactaaataattgcgggacgggcagaatgtcgggagaacatttcaggcgcaaaagggcgaaaaagctgggtttaatgaaatttattcacctttttttgaaaatagggtttgctattttcggctaccgtgctataatatttcttgtcggaaaaatataacttgtttatccagtaaaaagtatatttatccatttatttgaaaaaagttgttgacaagtattcaacatgatgataaagttaaatagttgtcaaggcataccagtaagaactgtttgaaccggcaacaaggcatgattaacatcatgcgggtgtggcggaactggcagacgcgctagatttaggttctagtgtcttacgacgtgggggttcgagtcccttcacccgcacatgccgacttagctcagttggcagagcatctcactagtaatgaggaggtcggaggttcgaatcctctagtcggcatttacaatttaatagctttattatgcggaagtagttcagtggtagaacatcaccttgccatggtgggggtcgcgggttcgaatcccgtcttccgcttttaatttgccggggtggcggaattggcagacgcacaggacttaaaatcctgcggttagtgataaccgtaccggttcgatcccggtcctcggcattttaaataagcacccatagcgcaattggatagagtgtctgactacgaatcagaaggttgtaggttcgactcctactgggtgcattagtatcgggaaatagctcagcttggtagagcacctggtttgggaccagggggtcgcaggttcgaatcctgttttcccgatcgtttaacacagtcttagttaagtgctaaggctttttatttaattttctcgggaagtagctcagcttggtagagcactacgttcgggacgtaggggtcgcaggttcaaatcctgttttcccgattacggttaaaccaactaatccagtcatttggctggattttttttatggccttttttgtaagcaggggtgtttcaacggtcaggggacacttttgcgacgttactcactaagtcagccatgtgaagaatacggtggttgtgactcataatcccgacaaggcaacagccactgttagtcatgagctcggagaaattagtctcggaactgctgttcatcgttgtgataccagtgcccatcgcctgcaatgaggagtgactcaacttgacatattttaaataggtagttcaatgaatatggagacctaataatttaatcattatgaggttctaaacggttgaatcaattgaaagcaaacgtttggcgtgctatgctgtaacaaccgttaagcacatgctagtccgcggtttgggtgaaattctttgcttttttccattatcctcgtataataatagtcaatattagtcaaagataatgaaaagggtgaagcacatgcaaagtcaaaatatctcggatattattgaaaagtatttaaaaagtattttggcggactcggagcatgttgaaattcgacggtcagaaattgccgaccttttcaacgtggtaccctcacagattaattatgtgattaagacccggtttacgatccaaaatggttacttagttgaaagtaaacgtggcggtggtggttatattcgcattgagaaggttaatttggtcgatgatgctgatgtgttggacgccctcatacaggtgatcggcgattcaatcacacaacgagatgcttatgcggtcgtccaaagtttatacgaggacgacgtcttaaatcgtcgagaagcgcaattgattttagtggcgattgaccacgagacgttaggattaacggaccgggacttagaaaacagtctgcgggcccggataattatcggaatcttgaaccacttgcgttacgaaagctaaagaaagcgaggaatcgcaatggataacttatttacacctagtgccaaaagtgtgctggtactggcacaggaacaggccaaatatttcaagcatcaggcagttggtacggagcatttgctattagcattggccatcgaaaagaatggaattgctaataaggtgctacaacaatatgccgttagtgaagatgacattcgtgaagaaatcgaacggttcactggctatgggacgttgagcaatgttggcaaggatacttacttgccatattcaccaaaggccaaagaaattttgtccgttgccggtgatgaagcaaaacggctcggtgccaacaagattggaacggaacatttgttgttagcgatgctctctgatgaaagtatcctttcctcgcgaattttaatgaatttaaacttagatctaggtcagacgcgtaaagtcgttcttcgcaagctaggtgtcagtgacgccatgagtaagcgcaagggtaacgcggctaatcgcggtggcaagaagactgaaggaacgccaaccttggattctctggcgcgcgatttgacccaattagctagtgaacaagaaatggacccggtagtaggtcgttccaaggaagtcaaacgggtcattcagatcctgtcacggcggacgaagaataatccggtcttgattggtgaacctggggttgggaagactgcaatcgccgaaggtctagcccaaaagatcgtggccggtgatgtaccaactgatatggcagataagcgcttgatgatgctcgatatgggatcattagtcgctgggacaaagtatcgtggtgaattcgaagaccgcctgaaaaaagtgattgatgaaatttacaacgatggccatgtgatcttatttatcgatgaattgcataccttgattggtgccggtggtgctgaaggggctattgatgcctctaatattctgaaacccgcacttgcacgaggggaactccaaacgattggggcaaccactttaaatgagtatcaaaagtacattgaatctgacgctgcgttggaacggcgttttgcaacggtcatggtcaatgaaccgaccgaagacgaagccgttgaaatattagatggactacggccacgctatgaagaacatcatcgggttacgattacggatgaagctgttgatcaagcagtcaagctatccagccggtatatcagtgatcgtttcttgcctgataaggccattgacttgatggatgaggcggcagctaaagtccgcatcgatcagatggatcaaccaacgaagctatccaagaaccaggacaagttagcgcaactgcgtgaggataaggaaacagcgatcgaagcacaagattttgaacaggccgctgatattcgtaagcaggagatgcaactgaagcaacgcctagatcgaatcgaagctgaccaagacgccgaagtgactgagggggcaacaccacactatgatttacaagtcacaggtgaggatattgctcaggtcgttgccgaatggaccggggttccgttaacgcaattgcaaaaatctgaaagtgaacgcttagttaacttggaaaagattttgcatgaacgggttgttggacagccagaagccgtatccgcagtggctcgtgctattcgccgtgcgcgcagcgggttgaaagatccgagtcggccaattggttcctttatgttcttaggaccaactggggttggtaagacggagctagcaaaagccttggcagcagcgatgttcgggtctgaagataatatgattcggatcgacatgtctgaatacatggaacgctattcgactagtcgtttgattggctcggcacctggttacgttggttatgacgagggcggtcagctgacagagaaggttcgccagaaaccatactcggtcgtgctatttgatgaagttgaaaaagctcatccggacgtctttaacattttgttacaagttttggatgacggctacttgacggattctaagggtcggaaggtagacttcagaaatacgattctgattatgacgtcgaaccttggggcaaccacacttcgtgatgaaaaatcagttggttttggtgcaactgataaggccaatgactacaatgcggttgctgcgacgattcgagcaacgttaaaacagacgttccgcccagaattcttaaaccggatcgacgaaacaatcgtcttccattcattgaataaggaagaattacacgaaatcgttaagttgatgtcacaagaaattgttgatcgagtggcccaacaaggtatcaagatcaaaatctctccggctgccattgacgtggttgcgaaggctggctttgatcctgagtacggagcacgaccaattcgacgggcattacagactgaaatcgaagatcggttgagtgaagaattattgaccggcgcgatcaaggtcgatgaccaagttacgattggtgctagcaagggtaccattacaattaatattaaaaaccagcctaaggcggatggtcgttcgaccgtttcctcaaagtaggcgcgattaaattaaagatgacgcttgaagtggtagtccacttcaggcgtcatcttttaggttcaatcggtattaagatgctacccactgaagtgaactgtaggatctgaggctggtggttcggtgctgattggtgtaaattataataggaaataaagtcaagaaagaagatgataacatggcgacacgagccgaacagatggcgaagacgcaccaggcaattttagacacagcccgggaactgtttttaagaaatgggtatgatgcgacaagtacgcgcgacattgcgaatgcgattggcattacgcagcccgcgctttatcaccattttaaagataaagaggtcatctttctggctgtcattacgacggtcggtgcggaaatcaaggctggcattgaagcgattcaagtccgtgcggattggtctccgttggatcaattaacagaagtctcgctattactaacgcataagcatccggctgatgtcttcacgttaattcattccagtttcaaagcattaacgcatgaacatattcgcgagttgggcggcatatttgttactgattatgtgaagccgattcaaaccgtttttgagcaacctgacatgcaactacatgtgggggtcacaccacagatggcgacgaatttctatatcaccagcttgagtccactgtttaacagttttcatcaaatcggtgatcctcatgctgacgagcggacccgcgttcaaactcttttaaagatgatcttatacggggttgcgagtgaaccagaaaactaatggcggcagagaagtctactagttgacaactaacgttattcgatgtatattataacttgtctgtaaccgtgaactcgagcgaacgcgcaatctattgtctgtgcggctcgttaatataaatccaaaaatagtcaacttaagcgactatttttggtttttttatgcctaaaattcggtcaaaaacgcatttgtaacacaaatgtaatatttggccggaggtggcgggttccggaataataagaaggggtgaacaacttggccggacatttagtaaaatacggtaaacaccgtacccgtagaagttatgcacgtatcaaggaagttcttgatttgcctaacttgatcgaaatccagaccgattcttaccaatggttcttggatgaaggtctccgggaaatgtttgaagatattatgccgatcgacgatttcgcaggaaaactttcacttgaatttgtcgactatcaattattagaaccaaagtacaccgtcgaagaagctcgtgaacatgatgccaactactcggcaccattgcacgttaccctacgtttaactaaccatgaaactggtgaaattaagtcgcaagacgtattcttcggtgattttccattaatgactgaacaagggacgtttattatcaacggtgccgaacgggtcattgtttcacaattggttcgttcacccggcgtttacttcaatgaagaattagataaaaatgggcgtcctagctacggcacaacggttattcctaaccggggtgcttggttagaacttgaaactgacgccaagaatgtctcatacgtacggatcgatcgtacgcggaagattccattgacggaattagtccgggccttaggctatggttctgacgatgacattattgacatgttgggtgaaactgacagtttgatgttgacgttggaaaaggacgttcataagaacaccgacgactcccgggttgaagaatccttaaaagatatctacgaacggctacgtcctggtgaacctaagacagctgacagttcgcggagcctattgactgctcggttcttcgatccaaaacggtatgacttcgcaccagttggtcgctacaaggttaacaagaagttaagcatgaagacgcgcttaatggaccaaacgttagctgagacattagctgatcctgatactggtgaagttattgcgcaaaaggatacggtcattgacaagaatgtcatggctaaactatccccatacttggaacgtgacgactttaagacggttacttacacaccatctgacgaagccgttgttacgaatccaatggtcttacaagttgttaaggtttattcacaaaacgaccctgaaaaggttgtgaacgtgattggtaatggcaacattgatttgaagttcaagcacattgtgcctgctgatatcattgcttccattaattacttcttcaacttgcaagaaggtcttggctcaaccgatgatattgatcacttgggtaaccggcggattcgttccgtgggtgaattattgcaaaaccaattccggattgggttatcccggatggaacgggttgtgcgtgaacggatgtcgattcaagatgctgcgacggtaacgccacaacaattgattaacattcgcccagtggttgcttcaattaaggaattctttgggtcatcacaattgtcacaattcatggaccaaaccaaccccttaggtgaattaacgcataagcggcgtttatcagccttaggacctggtggtttgactcgtgatcgggccggatatgaagttcgtgacgtgcactatacccactacggtcggatgtgcccaatcgaaacgcctgaaggccctaacattggtttgatcaacagtttgtcttcttatgcgaaggtcaaccgttacggcttcatcgaaacgccataccggcgtgtcgattggacaacgcataaggttaccgataagatcgactacttagcagccgatgaagaagaccaatttgtgattgcacaagccaactctccattgaatgatgatggttctttcgttgaagacactgttttagctcgtaacaaggaagaaaacttggaaacgccaatcgaaaatgtcgattacatggacgtttcgcctaaacaagtggttgccgtcgcaacggcatgtattcctttcttggaaaacgatgactctaaccgtgctttgatgggtgccaacatgcaacgacaagcggtgccgttacttgatcctcacgcgccattaattgggactgggattgaatataaagctgcacatgactcagggattgccttgatttgtcgtcatgaaggaacggttgaatacgttgatgctcgcgaagttcgcgttcgtcgcgatgatggttcattagacacttacaagttaatgaaattccgtcgttctaacggtggtaagaactataaccaacggccaatcgttaaagttggcgatcacgttgataacgatgaagtcttagccgatggtccagcaatggaaggtggggaattagcccttgggcaaaacccattagttgccttcatgacttggaatggttataacttcgaagatgccatcattattaatgaacgtttagtccgtgaagacgtctacacgtcaattcatattgaagaatatgaatcagaagcacgtgacaccaagcttggacctgaagaaatgactcgtgaaattcctaacgtcggggaagatgcattgaagaaccttgacgaagacgggattatccggattggggccgaagttaaagacggtgacatcttggttggtaaggtaacgcctaaaggggttacggaattgtcagctgaagaacggcttctccatgcgatctttggtgaaaaggcgcgtgaagttcgggatacgtcactccgggttcctcatggtggcggcggtatcatccaggacgttaagatctttactcgtgaaaacggtgatgaattatctcctggcgttaacatgatggttcgggtctacatcgcacaaaagcggaagatccaagttggtgacaagatggccggtcggcatggtaacaaagggacggtttcaatcgtggttcctgaagaagacatgccgtacatgcctgatgggacaccaatcgatatcatgttaagcccaatgggtgtgccttctcgtatgaatatcgggcaagtgctcgaattgcatttggggatggctgctcggaagttaggaattcacatggcaacgcctgtctttgatggtgctcaagatacagatatttgggaagccattcgtgaagctggggttgattcagatgccaagtcgatcgtctatgatggtcggactggtgaaccgttcgataagcgggtcgctgttggggtcatgcactacatgaagcttagtcacatggttgacgataagatccatgctcgttcaatcggaccttactctttggttacgcaacaaccacttggtgggaaagcgcaatttgggggccaacgtttcggtgaaatggaagtttgggccttggaagcttatggtgcagcttataccttgcaggaaatcttgacttacaagtccgatgacgttgttggtcgggttaagacctatgaagcaatcgttaagggcgaaccaattccaaagcctggcgtaccggaatcattccgcgtgttggttaaggaattgcaagcactcggtcttgacatgaaagtcttggattctgaagacaaagaaatcgaattgcgggacatggatgatgatgacgatgaagttgtcaatgtcgatgcactcagcaagtttaaacaacaacaagatgagaaggctgcggacaaggccgcaaaagctgacgccgctaagccttctgaaacaaccaacgctcagcaagataatcaataaaaagggaggtcggtcctttgatcgatgtcaacaagtttgaaagcatgcaaatcggtctggcatccccagacaagattcgcagctggtcatatggcgaagtcaaaaagccagaaaccattaactaccggacattgaaacctgaaaaagacggtctgtttgacgaacggatttttggtcctactaaggattgggaatgtgcttgtggtaaatacaaacggattcgttataagggtattgtctgtgaccgttgtggggtcgaagtgactcgtagtaaagtccgtcgtgaacggatgggtcatatcgaacttgccgcaccagttactcacatctggtactttaagggaattcctagccggatgggcttagtcttagacatgagtccccgggcacttgaagaaatcatttacttcgcttcatacgtcgttatcgaatctggtaatacgccacttgaaaagaagcaattactttctgaacgtgaataccgtgagaagaaggctcaatatggtaacgaatttgaagctgccatgggtgccgaagccatcaaacggttattgaataacgtggatcttgaaaaagaggcacgtgatttaaaggaaactctgaaggatgcttctggtcagaagcggacccgggccgttcggcggcttgatatcatcgaagctttcgtgacatctggtaacgaaccagcttggatggtaatggacgcaattccggttattcccccggacttacggccaatggttcaattggaaggtggtcgttttgccacctctgacttgaacgacttgtaccggcgggttatcaaccgtaataaccggttgaaacgcttgttggacttaaatgcacctgggattatcgtgcaaaacgaaaagcggatgttgcaagaagccgttgatgcgttgatcgataatggtcgtcgtggccgtcccgttgctggtcctggtaaccggccattgaagtctctttcacacatgttgaaagggaagcaagggcggttccgtcaaaacttacttggtaagcgggttgactattctggtcgttcggttatcgatgttgggcctttcttgaagatgaaccaaatgggcttaccacgtcaaatggcgttggaattgttcaaaccgtttatcatgaaggaattggttaaacgtgaattagcttctaacatcaagaatgctaagcgaaagatcgaacatgctgatgacgatgtctggggtgtgttggaagacgttatcaaggaacatcctgttctcttgaaccgcgcccctacgcttcaccgtttagggattcaagctttcgaacccgtcttggttagtggtaaagcgatgcggctccatccattggcttgtgaagcttacaacgccgatttcgatggggaccaaatggctattcacgtcccactttcagatgaagcccaagctgaagcacggctcttaatgttggctgcccaccatattttggcgcctaaggacgggaaacccgttgttacgccatctcaagatatggttatcggtaactactacttgacgactgaagaaatcggtcgtgaaggcgaaggtatgatcttcaaggacttgaatgaagcgcaaaaggcttaccaatcaggttatgtacatttgcatagccgggtcggcattcaggtctcatcaatgcctgacaagccattcacggacgatcagaagcaagcagtcttagtcacgacggttggtaaggcaatcttcaacaacattttgcctggcaagttcccttacttgaacgaaccaactaacgataacttgattgctggtacaccggacaagtatttcttgaagcctggtgaagatattcatcaattcttggatgcccaggaaatcattccaccattcaagaagggcttcttggccgacattatcgctgaagtttacaagcaatatcacgtgacagcaacgtcactcttgcttgaccggatgaaggacttaggttacaacatttcaactaagtctggtttgacggttggggttgccgatattactggtttgaaagaaaaaccagcaattatcgccgaagcccataaacaagttaatacgatttcgaaacagttccgtcgtggtttaattactgatgacgaacgttatgaacgggtcattggtgtctggaacgacgctaaggaccaaatccaacaaaaactgattgaaagtttcaacgcggataacccaatctttatgatgagtgattctggtgcgcgtggtaacatttcaaactttactcagttagctgggatgcgtggtttgatggctgcccctaacggtaagatcatggaattaccaatcctttcaaacttccgtgaaggtttgtctgtcttggaaatgttcatttcaacccacggtgctcgtaaagggatgaccgatacggcgcttaagactgccaactcaggttacttgactcggcgtctggttgatgtggctcaagatgttatcgttcgtgaaaaggattgtgggactgaccgtgggttgcggattcacgcaatcatggaaggtaacgaagtcatcgaaccgttgtatgaccggatcttaggtcgttacacgatgaagactgtctttgatcctgaaacgcatgatgaaattgttggtaacaacgtcttgatcgacgaagacttagctcataaaatcgttgatgctggtgtaacggaagttacgatccgttctgcatttacttgcaacactaagcatggggtttgtgaacattgctacggccgtaacatggctactggtgatgaagttgaagttggtgaagctgttgggacagttgccgcacagtctatcggtgaacccggtactcagctaaccatgcggaacttccataccggtggtgttgccggggacgatattacccaagggttgcctcgtgtgcaagaaattgtggaatcacggaatcctaaagggcgtgccgaaatctcagaagttactgggacggttgaattaattgaagaaaatccagcggaacggacgaaggaagttacggttaagggtgaaactgatacccggacttacacgttgccgttaacagcacggatggcggttagtgagggcgactttattcaccgtggtgctgcgttgaacattgggtcgatcgatcctaagcaattgattcaagtgcgtgatgtcttatcaactgaaaactacttgctccgtgaagttcaaaaggtttatcggatgcaaggggttgaaattggcgataagcacgttgaaatcatgattcggcaaatgttacggaaggttcgggtcatggatccgggcgataccgacgtcttgcctgggacgttaatggatattgcagacttcaaggacgagaactacaagaccttgattgctggtggtattcctgcaacgtcacggccagtcattcttgggattactaaagccgctcttgaaacgaatagtttcttgtcagctgcttcattccaggaaacgacacgggtcttaactgatgctgctattcgtggtaagaacgatccactgatcgggcttaaggaaaatgttatcatcggtaagatcattcctgctgggactggtatgccggtttaccgtcatatcaaaccaaaggaagttggcaacgtggctgatggggtttactcaatcagcgatcttgaaaaacaaatgcaagaacaagatgctagcaagtaattgctaagtaactaaaaagggcggccattgtggtcgtcctttttgtatgcacgattgtaggtaggctatctggggcgttcggcgatgaaggttaatcttcagggggggaagactaactgagcctcgctggaaaagttcaagtttgtgtaaacttgcttagttagtgtgtcctgcactgcgctccaggcatttctgctaattgctggactgccgtgccttaatactatattggtgaaacgtgttcagattggaatgagactttcggttagctaacactaatcctcagtctcagctcgtctaaaccgcacactcttgtagtgctaagaaacgtcttccgctcgggatggtgttcgaatggtgggcacgtgcgtacgcaacttttgacggattagtcgttacttttttgagaccggaatcttatcaggtaactttcaggttaataatagaattgtgagctgtccccgatttctaaatcaccatattactactgagggtcagaacaactgatacgatattaacgcttgtttaaagttccaagtagtaaacaattcgacgacaaattgtaccagttgagtggtcgttcatccgaacaggacgcgcactgactaacaagcaataatcggacgtactagaacattgcaattatagctcgctatgcgagacccgtgagttgggtgaccatgatgaagctccaactgatgaagggcacgaatggtaagcgatggcgtggggcactgatgataaaaccaactaatgcggcaacggccgcaatggcgagacaggtcaacagtgtgtcggctggaatgatgaagacgagcatgagtagaacgtcaacatcgccgagaccaaaggtggcagttagccgggccagcaagtatagtccgactagtaaggcaagtacgaggtagagactgatcgtcaggggtggccggtgttgccataagcccagtccggctggaagaagtaatgtcagcgggtagacttcaaaagtgagataatcagtaagactattgaaaatcaataccaagtaaccaatcagcagtggcagcgtcaatgacaatgacgcactgctagaagctagtagactaccacaaagtaattcaatcagactggaacggaggctgataggagtgcgacaatcatagcatcgcccccgttgaagcagaatgccgagtaatggtatcagttgccagaaccgtaattgatgccggcagtgtggacaccgtgatcgttgagtgctaatgagtatgtgtccgttgctgatgcgttccgccatacaggtcacgaatgagcccagacagaggccaataataaaaagactgctggttaacatggaaggaccacctttcatcactagttacgcaatgtaaagcatcactattttttcaggacatttattgacaacttcggcatgtcatgatagtctagtaaaggtgctttttgcagacagattcctgtatcaggaatacagacatgctgactggtcggctaagcgcacaattaccatgctccaggcattcttttttactcaaaaaagaaccacctggatgtgtggacttaaaaaacagatatttggaaggaggacactttagaacatgccaacaattaatcaattaattcgcaaaggccgtaagtctaaagtatcaaaatcaaatgccccagcgttaaactttgggtataacagttacaagaaggttgcaactaataacccagcgccacaaaagcgtggggttgctactcgtgtcggtaccatgactcctaagaagcctaactcggctttacggaagtatgcccgtgtacgtttatctaacttaatcgaagttacagcttacattcctggtattggtcataacctccaagaacatagcgttgtcttaattcgtggtggtcgtgttaaggatttacctggtgttcgttaccatgttatccgtggtgctttggatactgctggtgtcgaagatcgtcgccaaagccgttccaagtatggtaccaagaagccaaagaaataataaggaggtaagttaaatgccaagaaaaggtgcacctgcaaaacgcgaagttttagcagatccaatgtataactctaaattagtaacgcgtttaattaaccacttaatgttagatggtaagcgcggtaccgcatcaactattttgtatgatgcttttgatcaaatcaaagaacaaactggtaacgatcctttggaagtcttcgaagaagctatgaagaacgttatgccagtacttgaagttaaggcccgccgtgttggtggttctaactaccaagttccaatcgaagttcgcccagatcgtaagacgactcttggccttcgttggatcgttcagtatgctcgctcacgtggcgaacacactatgtccgaccggttagctcgtgaaatcatggatgctgctaacaatactggtgcttcagttaagaagcgtgaagatactcaccggatggctgaagccaaccgtgccttcgcccattatcgttggtaatatttccgtgagatggttaaaggtcgcctttaactaatcacaaaaaggtgactattatatgcgcgcatatagtagtcattttttgaaataaactttatactgttaattccatttatattgagaggagtaacacattttctaatggctaatacacgagaattctcactcgataagacccgtaatattggtattatggcccatatcgatgctggtaagaccacgactactgaacggatcttgtactacactggtaaaattcacaaaattggtgaaacccatgatggtgcttcacaaatggactggatggcccaagaacaagaacgtgggatcaccattacctctgctgccacgactgcacagtggaagaaccaccggattaacatcatcgataccccagggcacgttgacttcactgttgaagttgaacgttcacttcgggttttagatggtgcgatcgccgtattggatgcccaatcaggtgttgaacctcaaactgaaacagtttggcgtcaagcatcaacgtataacgttccccggatcgttttcgttaacaagatggacaagattggtgcggacttcaagtactctgtaagcacgatccatgatcgtttacaagctaacgcccacgccatccaattaccaattggtgccgaagataatttcgaaggggtcattgacttaatcgaaatgaaggctgacctttatgatgaagatcaacttggtactgaatgggatacggttgacgttcctgatgaatacaaagaagaagcccaagctgcacgtgatgacttaatcgaagccttagctgacatcgatgacggcatcatggaaaagtaccttggcggtgaagaaatcagcaaagaagaaattaaggctgctatccgtaaaggaacgttagcacttgaattcttcccagtattagctggttcagccttcaagaacaagggtgttcaaatgttaatggatgccgttgtggactacttaccatcaccacttgatgttaagccatacaaggctactgatcctgaaactgaagaagaggttgacttgattgccggtgatgacaaaccattcgctgccctagcatttaaggttgctactgacccattcgttggtcgtttgactttcatccgggtataccaaggtactttggaatctggttcatatgtcttgaacgctactaaggacaaacgtgaacgggttggtcgtttacttcaaatgcattctaaccaacggaaagaaatcccagaagttttctctggtgatatcgccgctgcaattggtttgaagaacacgactactggtgactcattgacttcgattgaccatccatatcacttggaatcaatggaattccctgacccagttatccaggttgccgttgaacctaagactaaggctgaccaagataagatgaacgttgccttacaaaagctttctgaagaagatcctactttcaaggctgaaactaaccctgaaactggtgaaactttgatcgccgggatgggtgaattgcatttggatatcatcgttgaccggatgcggcgtgaatttaacgttgaagccactgttggtgcgcctcaagtttcataccgtgaaacctttactaagagcactcaagttcaaggtaagtttgttcaccaatctggtggtaaaggtcaatatggggatgtttgggttgaatttacacctaacgaagaaggtaaaggcttcgaattcgaagatgccatcgtcggtggggttgttcctcgcgaatacattccttcagttgaacaaggtttgaaggaagctatggctaacggtgtgttagctggttatcctttggttgacgttaaggctaagctctatgatggttcttaccatgatgtcgattctagtgaagcagccttcaagattgccgcatcattagcattgcggaatgccgttaagactgctggccctgttatccttgaacctatcatgaaggttgatatcgttgccccagaagattacttaggtgatgttatgggtcacgttactgctcgtcgtggtaacatcgaaggtatggaagaacgtgggaatgcccaagaagttcatgcatacgttcctttggctgaaatgtttggttatgcaaccacattacgttcagctactcaaggtcgtgggactttcacaatgacctttgatcattacgaaaaggtaccaaagtcagttcaagaagatatcatcaagaagaatggcggcactcctgccaaataagcttgattgataataagaaggacgttcagcttcggctggacgttctttttttacataaatttctggtcgaactaaatgtgattactgctcgtcgtaagacaacgtggcacatcaattgaagcggcttgggatagtttggtcgtcactggcattgggtacggctgtgacgagcacagtgctgctcaggcctgtgtcatcgcgcaagggtacaatcgcgcaacaagggtcgcactagttaagttactagccgctgcgaccataaaactggcagccataatattaaagggtgcgagactcatagcataataaggagaacgcggacaacatcacattttttgtaccggagataaccacatgagttgacggttgtcggtgaccacggccaaggtgctgacggtcggtggtaagcagatgacaatataatagaaggtagatgaacaagaacgtgggtcagtgtgacggcgccgtcagatgtaggagcagttgaattaagcgtgttgaagtccgattaaatgactccagacaaaaatgcatgacgctgaacgcgggtcttgttcctgagaaaatgttaatgcaatctagtaggtgtccacatgatcgtggccggtcgacagtgagaaatgtaaagcgctcaccaaaaagaaattaggcgcaaacgctattaattggatggaatttgtgttacattaattgagctggttcaaaaaggtaacacggtttacaacgatggttataaaaaaagtgcgaaaacacttgctattacagagcttttcatttattatagattgtgcttggtatttagaaggggataactatatccccatcatcaagtagtcgtagttagctttgatgtgaaaggttgcgacacgcccggccacattgtcatgggacgtggcggtaattttcacggagctagtcttattttcaaaatagacgaaggaggtcacaacaatggcaaagcaaaaaattcgtattcgcttaaaggcatacgaacaccgcattcttgatcagtcagctgacaagattgtcgaaacggcaaagagaactggtgctactatttcaggtcctattccattgcctactgaacggactatttataccgttctacgttcaccacataagtttaaggactcacgtgaacaattcgaaatgcgaactcacaagcggttaatcgatatcgttaacccaacgcctaagacggtcgactcattaatgaagttagacttgcctagcggtgtagatattgaaatcaagctttaatttactaaactaaaatcaattaattggaggtgtactcatgaccactaaaggaatcttagggaaaaaggtaggaatgacgcaagtcttcactgaaagcggcgaattagttcccgttacagttgttgaagttcaacctaacgttgtgttgcaagttaagaccgttgaaaatgacggttacgaagcaatccaattaggtgttgacgacaaacgcgaagtcttgacgaacaaacctgctcaaggtcatgcagcaaaagcaaaaacgactcctaagcgcttcattcgtgaaattcgtaatgttgagcttggagattacacagtaggtgacgaagtcaaagcggatattttcgcagctggcgacgccgttgacgttacgggtatcactaaaggtcatggttaccaaggtaatatccataaggacggccaaagtcgtggaccaatggctcacggttctcgttaccatcgtcgtcctggttcaatgggtgccatcatcaaccgggtattcaaaggtaagaaattaccaggccggatgggtaatcaccaacgtacgatgcaaaacttacaaatcgttcgtgccgacgttgaaaacaacgttttattaattaaagggaatgtccctggcgccaacaagtcatttgtaacagttaaaacatctgttaagagtaaataaggaaggaggacataatacatgactagcgtagcattatttaaacaagacggtacgcaaaatggtgacgttactttgaacgacgctgtgtttggtgttgaaccaaacgaaaacgtggtttttgatgccatcttgatgcaacgtgcatcaatgcgtcaaggaactcacgcagttaagaaccgtagtgctcgtcgcggtggtggtcgtaaaccatggcgtcaaaagggtactggtcgtgcgcgtcaaggttctatccgttcaccacaatggcgtaaaggtgggattgtcttcggaccaacccctcgttcatacagttacaaattacctaagaaggttatgcgcttagctttgaagtctgtcctttcacaaaaggtcttagacaacagcttagttgcagttgatagcttagctttcgacgcaccaaagactaaggattttgtaaatgtattaaacaacctcaacgtcgataccaagactcttgttttggttgaagaggacaatgaaaaggctgctttggcaggtcgtaacttaccaaatgttaagatccttaaagccaaaggtgttaacgtcttagatgtcgctaatagtgacaaattagtcgttacccaaaaagccctcgatcaattagaggaggcgctcgcataatggaagcacgcgatgtaattttacgtcctgtagttactgaatcatcaatggctgacttggacgacaagcgctacacatttgatgtcaacgtacaggcaacgaaaacccaagttaaaaaagcaatcgaagaaatcttcgatgttaaagtcgttaaagtgaacgttatgaacgttaaaggaaaacttaagcgccaaggtcgttacgccggctacactaagaagcgtcgtaaggctattgttaccttaagttctgattctaacgaaatcaagttgttcaacgacgatcaacaataaatctaatttaggaggtaactctagtgggtattaagaagtataaaccaaccactaacggccgtcgtaatatgactgcttcagatttctctgaaatcactaagacgaagcctgaaaagtcattattagactcacaaagtcacactgccggtcgtaacagttatggtcacattactgttcgtcatcgtggcggcggtcataagcaacaataccgtttggttgactttaagcggattaaggatgaagttccagcaaccgttaaggcaatcgaatatgatcctaaccggacagctaacattgcattattagtttacgctgacggtgtgaaatcatatatcttagcaccaaaaggtttggaagttggtatgcaagttcaatcaggtgccgaagccgacatcaaggttggtaacgcattaccattaactaacatccctgttggtactgttattcacaacattgaattgaagccaggtaagggtggccaattagctcgctctgctggtacttcagcacaattactgggtaaggaaggcaagtacgcaattgttcgtttgtcttctggtgaagttcgtttagtattattaactagccgtgctactattggtactgttggtaatgaacaacacgaattaatcaactcaggtaaagccggtcgtacacgctggcaaggtaagcgcccaactgttcgtggttctgtaatgaaccctaacgatcaccctcatggtggtggtgaaggtaaagcaccaatcggtcatccatctccaatgtctccatggggtaagaagacgcttggtaagaagactcggaacaagaaggctcgttcaaacaagcttatcgttcgtggtcgccgtccaggcaaacactaataaaatttgaatttactgtagttatcgagaggaggtcacacgatgggtcgtagtttaaagaagggacctttcgcagatgcgcatttattaaagaaaatcgatgcacaatctgattctgacaagaaatctgtcatcaagacgtggtcacgtcgttcaacaattttcccaagtttcatcgggtacacaatcgctgtttatgatggtcgcaagcatgtcccagtttacatccaagacgatatggtcggtcataagttaggtgaatttgtaccaacacggacgttccatggtcatggaactgacgataagaaaacgaagtaatagttaggaggatataaagaatggctgaacaagtaacatctgcacgtgcaactgcaaaaactgttcgtattgccgctcgtaaggtccgcctagttgtcgatcttatcagaggtaaaagtgttgccgaagccttagcaatcttgaagttcactccacggggtgcttctccagtagtagaaaaagttttactttctgctgttgctaacgctgaaaataactttgacttagatcgtgaagatttggtcgtaagcgaagcttttgttaacgaaggaccaaccttaaaacggttccgtccacgggcaaaaggttctgcttcaccaatcaacaagcggactagccacattacgatcacagttactgaaaaataggagggataacgcgtgggtcaaaaagtaaatccaaccggattacgtgtaggaatcattcgcgactgggaagcaaaatggtacgctgaaaaagattttgctgcctacttgaacgaagatttacgcatccgtaagtatatcgaacaacgacttgccgacgcttccgtctccaccgttgaaatcgaacgcgctgcaaaccgcgtaaacatttcaatccataccgcaaaaccagggatggttattggtaagggtggttctgaagttgaagctcttcgtaaagaattaaacaatttaactggtaagcgagtacacatcaacatcatcgaaatcaagaagcctgatttagatgctaaattagttggtgaaagtattgcgcgtcaattggaaggccgggttgctttccgtcgtgcgatgcgtggtgctatgcaacgtacaatgcgttccggtgctaagggtattaagacacaagttgctggccgtttaaacggtgccgacatgtctcgtgttgaagcatactcagatggtacggttccattgcatacgcttcgtgctgacatcgactattcatgggtcgaagcacggacgacttacggtaaattaggtgttaagacctggatctaccgtggcgaaatcttgccagaaaagaaatctgctaaaggaggaaactaaacatgctggtacctaaacgggttaagtatcgtcgtgttcatcgtggtaaaatgcgcggtgaagctaaaggcggtaaaacagttgcttttggtgattacggtttacaaaccctcgaatcacactggatcagcaaccggcagattgaagctgcccgtgttgctatgaaccgttacatgaagcgtggcggtaaggtatggattaagattttccctcacaagtcctacactgaaaaaggtgtcggtgtccggatgggtaatgggaaaggtactcctgcaggttgggtagcaccagttaaacgtaacaagattatgtttgaagttgctggtgttccagaagaagttgcacgcgaagctttacgcttggctggaactaaattacctgttaaaactaagattgttaagcgtgaggaagtaggtggcgaatcagatgaaggctaaggaaattaaagcattgtccactactgaaatgctcgaaaaagaaaagtcttacaaagacgaacttttcaacttgcgttttcaattggccactggtcagcttgaaaacaccgctcgtttaaaacaagttcgtaagaacattgcgcgtattaaaactgcgttgcgtgaacaagagttaaacaagtagagtataaaggaggcaatcacgaatgagtgaagatactcgtaatagccgtaaggttatccaaggacgcgttgtttctgacaagatggacaaaaccattgttgttattgtcgaaacttacaagaaccatccggtatacggcaaacgtgttcgttattcaaagaaattcaaggctcatgatgaaaagaatgaagccaaaactggcgataccgtcaagatcatggaaactcgtcctctatcagctactaagcgtttccgcttaattgaagttgttcaaaaagctgttattatctagattattagctgaataaaattacatgaagggaggacacttactgtgatccaacaagaaagtcgtttaaaagttgctgacaactccggtgcccgtgaaatccttactattaaggtattaggtggctctggtcgtaaaactgctaacattggtgatgtcattgttgctacggttaaacaagcaacacccggtggtgttgtcaaagctcatgatgtcgttaaagctgtgatcgtccggactaagtctggtgttcaccgtgctgacggttcatacatcaagtttgatgaaaatgctgcagttattattcgtgatgacaagactccacaaggtactcgtatctttggacctgtcgctcgtgaattacgtgataaggacttcatgcgtattgtttcattagcgccagaagtactctagtcacacaccgtaaataaggaggtgcgcaacctaatgttgattaaaactggtgataaagttcgagtaatcagcggtaaggatcgtggtcaagaaggtactgttaaaaaggttatctctgccaagaaccggatcgttgttgaaggtgttaacaagatcaagaaacaccaaaaaccaacgaacgttaacccacaaggcggtatcgtggacatcgaagcaccaatcgatgcttctaacgttatgtacattgacccatcaaccaacgaacctacacgtttaggtgttcgtcgtgaagatggcaagcgtgtccgttacgctaaaaagtctggtaaagacttagaaaactaagactgactgaaaggaggaagcaagtttcatggaaaaccgtttaaaagctcaatatgaaaaagaaatcgttccagcattagttgacaagttcaattacacttcagtaatgcaagtgcctaagctggctaagatcgttttgaacatgggtgttggtgatgcagttaccaacgctaaaaacttagacgaagcagttgaagaattaactttgatctccggtcaaaaaccattggttacccgggcaaagaaatctatcgctggtttccgtcttcgtgaaggtatggcaattggtgccaaggttgacttacgtggcgaacgtatgtatgacttcttggacaagttgatcaatgtttcattaccacgtgttcgtgacttccatggtgtaagtactcgttcatttgatggtcgcggtaactacacattgggtgtccgtgaacaattgatcttcccagaaatcaactatgataatgttaaccgtgttcgcggtttagacattgtaatcgttacgacagctgatagtgatgaagaatcacgtgagttgttaactcaatttggcatgccatttgctaaataaccgaagggggttaatcgaagttggctaaaaaatcacaaattgctaaacaaaagcgcggtgctaagtttaacgtacaaaactacacccgttgtgaacgttgtggtcgtccacattcagtttaccgtaaattccacttgtgccgtatctgcttacgcgacctggcccacaaaggtcaaatccctggtatgaaaaaggccagctggtaaaaacaaacccaagttaaaggaggttaaactttcatgatgactgatccaatcgcagatttcttgactcgtatccgtaacgctaacatggtacgccacgattcactagaagttcctgcatcaaaaatcaaacgcaacattgctgaaattttaaagaatgaaggttttgttcgcgacgttgaatacatcgatgatgacaaacagggcatcatccgcgtcttcttgaagtatggtaaggacaacgaacgtgtaatcagtggcttgaagcgtatttcaaagccaggtttacgttcatacgtcaaggctgatgctgttcctaaggttttaaacggtttagggattgctatcatctcaacttcagaaggtgtcattactgataaagaagctcgcgccaagaagcttggcggcgaagtattagcttacgtttggtaatcattaattaagacgggaggtgcaagtaagtgagtcgtattggttataaagtaattgaactacctgctggggtagaagtatcacaagctggtgaagtcgttacggttaagggtcctaagggtactttaacgcggaacatcgccagtgatattacgatgacggttgaaggcaacgaagttaaattcactcgtccatctgatgactacaagatgaaggcattacacggtactacccgtgcaaatgttaacaacatggttgaaggggttactaagggctttactaagaaccttcaattggtcggtgttggttaccgtgcccaattgcaaggcaagaagttagtattaagcgttggttactcacaccctgttgaattcgcaacgcctgaaaacttgactgttgaagttcctgataacacgcatatcaatatttctggtattggtaagcaagctgttggtgactttgctgccgaagttcgggccgttcgttcacctgaaccttacaaaggtaaagggattcgttacgtcgatgaatatgttcgtcgtaaggaaggtaagactggtaaataatgcagcgtaaagctgtccatactaatatatagaggtgactattgtgatttccaaaccagataaaaacaaaacacgtcaacgtcgtcacgcacgtgttcgcggtaagatttctgggactgctgagcgcccacgcttaaatgtttatcgttcaaacaaaaacatctacgctcaagttattgatgatgtagagggtgtaacgctcgcaagtgcctcaactttagatagcgaagttaaaggtaacaacaagactgaaaaggctgcatctgtcggtgaagttgttgctaagcgcgctgctgaaaagaaaatcgttgacgtcgttttcgatcgtggcggttacttatatcacggtcgggttcaagctttggctgaagccgctcgtgaaaacggacttaaattctaacaaaggaggaataataccatatgactttcattgatccatcaaaattagatcttgacgataatgttgttgccattaaccggattaccaaagttgttaaaggtggtcgtcgcctacgttttgctgcattagtaatcgttggggaccacaagggacacgttggtttcggtactggtaaggctcaagaagttccagaagcaattcggaaagcttccgaagctgctaaaaagaacttgatcactgtaccaatggttggtaccaccattcctcatgaagcacttggtgtttacggtggtggccgcatcatgcttaagccagccgttgaaggttctggtgttgccgctggtggcgccgttcgtgccgtcatggaattagccggtgtggatgatgttactagtaaacgattaggctcgaacacccccgttaacgttgttcgtgcaacgttcgaaggcttaaagagcttaaagactgctgaacaagtcgctgctttacgtggcgtttcagccgaacatttagctgaatagggaggacaaacaacatggctcaattaaagatcactttagtacgcagtgctgctcaccgtcttcctaagcaacgtaaaatcgttaaggaattaggtttgggtcggattaatagttccgttgttaaacctgatgacgcagcaactcgcggtcaaattttccacatcgcacatttagtcgatgtcgaaatcatcaagtaattcaaattttcaaagaggaggtgcctactaaatgaagttacatgaattaacacctagtgaaggttcacgtttttcacgtcgtcgaattggtcgtggtgactcaagtggccaaggtaagacttctggtcgtggccaaaaaggtcaaaaggcgcgtggtaaagttcgtgtcggtttcgaaggtggccaaatgccattgtaccgtcggattcctaagcgtggatttactaacattaaccgtaaagaatatgcggttgttaaccttgacggcttaaaccgttttgatgatggtgccgaagttacaccagaatcattaaaggaagctggcttagttaagaagagttctgctgttaaagttcttggtaatggtaaactcaacaaaaagttaacagttaaggcaagcaagttctctgcaacggcggttgcagccattgaagctgctggcggtaaaactgaggtgatctaatttgctgactaccatgaagaacgctctcaaagttaaggatattcggaataaacttctgttcacgttgggcgttttgattgtatttcgtcttggctcttatatcacagttcctggagttaatgcacaggcacttcagtcggtggcatcttcagggctgataagtatgttgaatacattcagtggtggcggtttaacaaattattccatccttgctatgggggtatccccttacattactgcacaaatcatcgttcaattgttacaaatggacattgttcctaagtttgttgaatggggcaaacaaggtgaagttggtcgacgcaagcttaatcaagcgacccgttggttaacgatcgtcttggcctttgttcagtcgattgggattacggctggttttaactctttgagtcaactcaagctcgttaacaatccaagtatttcgacttacctgaccattggggtgatcctcactggtggggcaatgttgacgacttggatgggtgatatgattacggatcgaggaatcggtaatggggtttccattattatcttcgccgggatcattgcccgtatgccaacatcgatttatcaaatttatcaagaacagttcgttaatgtttcacagagcgactggtggaagagtggcttgtttgttgttgggttagccttgcttgtgctgatcatcgttatgtttgtaacgtgggtcgaacaagctaatgaccgaattccaattcaatacactcgtcgtgcagctggtgcacctgacagtagttacctaccattaaaggtgaacgttgccggggttattcctgttattttcgcgagttccttcattgcaacgccccaaacgattttgctagggttccaatccagtcatggtgacgaaacctggtatactgttttgagtaatatcttcaatatgcagtcgacgactggtgctattctttacaccattctgatcgtgctcttcacgttcttctatgcgtttgttcaggtcaatcctgaaaagctctctaagaacttacaaaagcaaggcagctatattcctggtgtttggccaggtaaggatactcaagattgggtttcaaaattgttaatgcgactaagtacggtcggtgccctctaccttgggttgatttccttgattccattattagcttctgatatttggggtctcgatgaatcaatcggtttaggtgggacgagtttactaatcgttgttggggttgcccttgaaacaattcgtcaaattaaaggattgatgatgaaacgtgactatgtcggtttcattcgttaatcagcgaatgtgttggggagactcaacacatttgtgcattcaggaggaaaaaacatgtcaacaatgaacctgattttaatgggattaccgggtgccggtaagggtactcaagcacagaagattcttgaagattttgatattccacatatctcgaccggagatatcttccgtgcagccattaagaacgaaacgaagatgggcttggaagccaagaagtatattgatgcaggtaacttagtaccagacgaagtcactaacggcatcgtccgtgatcggttagctgaagcggatactaaaaatggtttcctattagatggttatccacgtaacatcgatcaagctcatgctttgaaacaaatcggtgaagaactcaataagccacttgatggggtcatcaacattcatgttgaacccgcagtacttgttgaacgactttccggtcggtttatctgccggacttgcggtgcaacttaccataagttgtacaacaagcctaaggtagaaggaacctgtgatgtgtgtggcggtcatgatttctatcaacgtgatgatgacaagccagcaaccgttaagaatcggttagacgtgaacattaagttgaacacgccattaattgattattacggtcaagaaaagttactctacaatgtcgacggtgatcgcgacattgatgatgtctacaaagatatcaagaaaattcttgataacctgtaaaccaggttccttcagcagcgacgtttgcttttcaaaggtcgttgtgataaaattattcaggtttagccgttgactgatttaatatttttttaatgttatgattagacaatgactggttcagtaatggaccaaatacgtggtagcacggaatctgataataaggagggacagtacttggcaaaggaagacgtcatcgaaattcaaggaaccattaaagaaacgttgccgaacgcaatgtttaaggttgaacttgaaaacggcgctgaaatcttggcacacgtatcaggtaagattcggatgcattacattcgaattctgcctggtgacaaggttacagttgaaatgtcaccttatgatttaactaagggccggattacctaccgtttcaagtaggctcggtctacgtaccttataggaggtaaaaaactcatgaaagtaagaccatctgtaaagccaatgtgcgaacactgcaaagttattcgtcgtaaaggccgcgtgatgattatctgctctgctaatccaaagcataagcaacgccaaggtaaataatttaattaagttggaggtgaaatattaatggctcgtattgaagggattgacttaccacgtgacaagcgtattgtcattggtttgacttatatctacggtatcggtaacacttctgcacagaagatccttgctgaagccggcgtttcagaagacgttcgtgtacgtgatttaactcctgaccaggaagacaaaatccgtgccgttgtcgatggttacaaaactgaaggtgacttacgtcgtgaagtcagcttaaacatcaagttattgcaagaaatcggttcataccgtggcatgcgtcatcgtcgtggtttaccagttcgtggtcaacatacgaagaacaatgctcgtactcgtaagggtaaaaaggtcagcatcgctggacgtaaaaaataataataaaggaggttttcgaattttatggcaactagaaagacaacccgtcgtcgtcgggtaaagaagaacattgaatctggtgtggctcacatccattcaacgttcaacaacacacttgttatgatcactgatatgcaagggaacgccattgcatggtcatcagctggttcattaggtttcaaaggtagtcgtaagtcaacaccttttgctgctcaaatggctgcagaagctgctgctaaggcatcaatggaacatggtatgaagactgttgaagtcgctgttaagggtcctggttcaggccgtgaagccgctatccgtgctttacaagctactggtttggaagttagcgcaattcgcgatgttacgccagtgcctcacaatggttctcgtcctccaaagcgtcgtcgtgtttaatctgtgacgttcattttgagggcaaacttcattttgtacgcacaactactaaacaccacgcgttttgaaaggggtaaaagataagaatgattgaatttgaaaaacctaacattcataaaattgatgaaaacgacaactatggtaagtttgttgtagaaccgcttgaacgcggttatggtacaactttagggaattcacttcgtcggattcttctttcttctttacctggcgctgctgttactagtattcaaattgatggtgttcttcatgaattttcaacgattgagggcgtaacggaagacgttacggcaattatcttgaatgttaagaagattgcacttaagttggaatcagacgaaaccaagacgttggaaatcgacgttaagggtcctgctaacgttactgccggtgatatcattggcgatgcggacgtagaagtcttgaatccagacttaccaatttgtaccgtagcagacggggcacacttccatatgcgtatgaccgcaaatactggtcgtggttatgtttccgctgaggataacaaacatcgtgaagatgacatgccaattggcgttttagctgttgattcattgtattctccaatcgaacgtgtcaactaccaagttgaaaacacgcgggttggtcaacgtgatgatttcgataagttaaccttagacgtttggacaaatggttcaatcactccaagtgaagccattagtctatcagccaaaatcctgactgatcacctttcaatcttcgtaaatctcaccgatgaagctaaaaacactgacgtgatggtcgagaaggaagaaacgcataaggaaaagatgttagaaatgacgattgaagagttagatctctccgtccgttcatacaattgcttgaagcgtgctggcatcaacacggtccaagaattaactaacaaaactgaagctgatatgatgaaggttcgcaaccttggacgcaagtcactcgaggaagttaaggcaaaattagctgaccttgggttatcattacgcaaagaagactaatacaagggaggatatccattcatgagttaccgtaaattacaacgtacaagttcacaacgtcgtgccttattacgcgatttgacaacgtcattgatcgttaacggcaagatcgagacgaccgaagcccgtgctaaggaagttcgttcaactgctgacaaaatgatctctttggccaagaagggtgatttaagcgcccgtcggaaggctgccgcattcatgcgggacgtcgttgccgatgttaaggaagatggcgacaacgtggctgtacaaactgcattgcaaaagctatttagtgacttaggtcctcaatatgctgaccgcaatggtggttacacacgaatttacaagactatgcctcgtcgtggcgacggtgcacaaatggttgtcttggaactcgttgactagttaagattgttttacggatcactgggactgatgattgacgggcgttatgatggtggctactggcaaaatagtagctaagtctagttcggaagttatttatggttagacatagatggcatatcgcagttctaagtgattttttttggtgctagttacgagcaaccgctgatttagggattgattccctaaatcagcggttttttgttggaatggataggtgtttttaatactcgtgatgacaacggtttgttatttgcagattatgacctgttgaatcgggaaagtggatatagtggtctcaggtactgactgtgaagatgaagcacatgggcgtttagctgtgtctgggcgacaaaaaaggtatcaaacaggatgtttgataccttagtcgattgattactagttaattatgccggtccaacagccgtttggttagactaatcagatccgtcttcgcaggctggtctggaagtttacgcatgattgccagcgcgtcttgagtgtacttggtagcgagttcttgggcttgcaccacaccgccggcattgatgacaagtcgttgtacttcctggcgctgagtgtccgaaattgccccctgtaatcgcatcagcggcaataaatcgtgcttagcttctgtctgtaaggcaaagatcaacggcgaggtgtagacaccttcagcaacgtcttcgaggatgggtttgcccgtttcctgactgacttcttgatagtctaaaatatcgtcaagaatttggaaggccatcccaattgcgagacctgctttacgagcgcgctgggcgaaatgactactttgaccagattcataagcacctagaaaacaactcagtgcgaataattcggcggtcttaccttgaatttgttgcaagtattctgccatggtaatgtcaaggtggtagtggcggtccttttgttggacctcgcccactagaatcttttccatgttctcagagttcatctggatgcttttgaaactgcttgaatagtgcgctagaatcttgaataccacaacgaataggtagtcgcccgcatacacagcagtatctttaccaaaacgttcttgaatcgtgacatggtgccgacgtagtgcagcatcgtcaacaatgtcatcatggatcagcgtagcggtatggagcgtttctaatgacgccgctaaggccaccatccgttgccgatcagttgttgtaaattgtgagaataggaggcagtatgccgggcgtaagagcttaccaccaccatgaatcatttctaaaatcgcgtcattgatgtcggcatcttgaatattgatgttcgccgtcatcagctgcatcacttgttgcagctccggttgtagtgccgggtaatcacgccaaattgggtgtaattgtgttgccgattgcataagggttactcctttgtttgatctggatggtgttctcgattgaatttgagatagcgtaagatcgtgacgtgggtgaacaagtagttggcggcgattccgagagcacttcccgctgctagtccaataatcgaaagcactggcaagtagagcatgaccgtccacgtctgtgcaataagactcgcgaccaatagctgaccaacattatgcatgacgccgccagttgctgaaatcccaataatactaacgcgtttaggccctaattgtttgaccagcagcatggcaaacaggctgagaaaggcgcccccaaaactatacggaaaggttgataaagtgccacctaggagggccgttaaaatcaaacggagccaggttagggttatcacgtcagttaatgataatgtatagattgcaacaatggtaatcagattggctaaaccaagcttggcacctggggcaaaggcaaacgggaatggaatcatccgttcaaggatgccgatgatcacgccttgtgcaaccagtaacgcgatataaatattacgatgagttttgtttgatcgttcaaatgaattattcatattctactccgtaactaaaccattaccgccagatttgacttgaccgttgctggccttaatttcaaccaagagtttgtggggcaaacaaacaatcgtttgaccaggtttatgaatccagcctcggcggacacatacttggtcagaacagttggctttcgtaatcgcaacgcgcttaggtttaaatgtgatcgtgttgtagtgcccatggttatcacgataggtgaagtgcttagtcgttttcagattcgtaatattgacacgcttcaagacggtcccattatgtgagaccacggcgttatacgtggtttcactgctcgtggcctttcgcttagccactagtgccgcatgttcagcttgttgtttttgctggtatgaaaaaatcgctagtggggtgaacgataaaataattagcgcaacaataataataatatcaaacggcttgatcatatccccataacgtttgaatgtccggatcattgtccgtaatttacgcatcgttaaccctccaattcaatgaaataaaaaatggttcaagggggaaaaacaacccttgaaccatcgggaaaggatttaattaattataacgcatctagcgggttttaacaccgtcgtaatgagaacgaacgttgccgtaccaccagtgtccaaggtgtttttgcatccacggaacgacccagtagtctaacccaaatgtccgtccggaaccgttcattaaggcgagggcaacaaagatcatccaaatgttgacccagtagaacatgccagataagcagaagacgacaactaagccaatggtgactgcgttagcaaaccaagtaaagagtccgaagaaaatacataatgcaatgacgatttcaacacaagtcatgaatttctggaagaagagggccatttgcatgttcggaatgaagaccttggtaattgattcgaaccaatgtggcattttgtcaaagaccatcaggggttctttaccgtacatatatgaaagactgaagacacccttagcggctttagcggttgacgtggcagcttcagaagcaccactggttgcagcggctttagttgcttgagaggcaccactggttgcggccacggtaatccattcgaatggtaaccgtaacttgtcagtgaaccaggattcagatccctgaactttagtccagcagtcccataaccacatggcaccatagaagaaccgcagtggcacactccagagtacgttaccagcccgtgagacccaaccgcggaagacgttacggttattacgagtccggaagaattcgtgcatgaagtactggaataggtagtaacctgagaaaatctgaacgtagtacatccagttgatggcgtgttttaaaagcacggcaataaaaccagagacgttccacttctctaaaacttgtgcaacggcatatttggaaccaattgagtcgacggatgcttgataagcgcccttaaatggcttgatcgtaacgtcagtctggtcaacgttcttaataataccttcgacggccttagctgcggtttcttcagccccttgaacgatttgtgggactggccgtggttggtcaggttcttggtagctggttgaatcaccggctaagaagatattgttacaatccttagcttgcatgaattcattggccatcaagcgaccaccgcggggattagtttcaatgccaaactttttaacgatactattagcacgaacaccggctgtccagattaacgtgtaggttggaattggatccttgccttttaagttaacatggtcttcacagacttcggtaatcatggagttcgtcatgattttgacaccatgtttttccatgtacttagcggccttaccggcttgcgtccggttgagcatgttaataatagtcggcgctgcttcgaccaattggagcgtgatttcacttggatcgagcttgttgtcttgagccaaaacatcacgatattcgattaattcaccaatcagttcagaaccagtaaaaccagaaccacagactgtaaaggtcaacatggctttgcgcttagcagggtcgagctccgccgccccccgccgaataattgcagataagtgagcgcgcaatgccatcgcttgttcgaaggaccacaattcgaagccgtgttccttaacaccgggagtcccaaagtcattggattccccacccaaactaattaaaagttgatcatattgataacttccgtgttcggtagtaactgtttgtgcctttttgtcgatgcccgtcacggtatcggtcacgagacgaacgttttttcgccgtgcgaacaaccgttgcaaatcatattggatatgctcaggttccacccgttcggtagcaacttcatgtaattcagtcatatacgtgaagtatgaatgccggtcaatcaacgtaatctcgacgtctgcattttttttgaaatgcttagacagtttcttggttgcgtaaacaccagcaaaccccgcaccgacaacgacaatatttttctttgccattgcgtaacaactcccttgaataatagtgtaaaaagataattccactaataattataacgataatgtaagcggttgtctatggattgtgggaaagaatgcataaactatcacattatctaagccgcgaaaataatggcatcgaggtttgaacggaaaacgttgtcaataccgctattattaggttaaaatatcatttttttaatggaatgggattgactattaccagtttaaacgttaagattaatgtgaattttcatacaaaaaggttaggagtgggatatcatgaaattcaaatcagttattacgggtgcttcagttgttgcaatttcagctttagctttagcaggttgtggcagcagttcttcaagttctagctcgagttcatccaagaagagttcatcttcaagctcatcagctaagacaactaaggttgctaaattaaccgctggcagcaaaatgaaagcgggtacttataaccttgaagaagaaaattattcacatggttatcggaccaagatgagtatcacagttaataacaacggtaaaatcactaagtccagttatgaccaagtgaacaagaacggcaagtccaaagttgatgatacttcatataacaaacaaatgaagaagatcgctgggactaaccccaagacttacatgcctaagttaaacaagacgctgacgggctctgccgctactggtaacgtgggctccattgatgttgtgactggtgcaactgaatcatcaaagaccttccaaaactacacacaacaattagttcaagctgcccaagcgggtaacaagtcgaccattaagattgacaatggtgccaagatgaaagatggtacctacaagttgaacgaaaagaactactcacacggttacaaagttactttcgcaatcacggtcaaggataataagattacgaagtctgaatataaccaagtgaacaagaatggcaagtccaaagttgacgatgcagcttacaacaagcaaatgaagaaggttgctaagactaaccctaagacttatcaaccagctttgaacaagtcattagttaagagtagtgatccaactaaggttgacgttgtcacgggtgccactgaatcttctaacacctttattatgtacgcggaacaattacaaaacgcggcacaaaagggtgacaccaacacgattactgttgacaacatgattttctctgaataagcaatttaattattagattcttttgaggcctgaggcgcatgctgagggccttttgtttttaattgaacaaccacaaaagtttgtcactcagttgggcacgactttgagcaagctaaatccatacatggatattggtttaaaaaataatagtggcggtgaatgttaagtgcaaaatggctgtggtagtacaaacccgaccgtcgagttgtaccgtttgctgtaggtgcgctgatgtcagactagcgtagaaaagcttggatgacgcgcaaacagtctcaccggatgaatcaagactttggtataatgacaattgaaattaaaaataggggaagtattggaatgaagctaaaaaaatgggttcgaattggattaattgttgcaatgatcgtgccattgacggcgtgtgggacgagtacgagtcgcaaaaatgctgctagtagccgacccaaaccaactaaggtcgtcaagacgccgatcgaggatacccagttcatgatgggcacagttgtcacgttgcggatttataataagggtaaggataacgtgttagctggggcgtttaagctgttgaaaacggaagctaaggaaattacggtcaatcaaaaaggatctgaaattgataagatcaacgccgctgccggtaaaaatccagtggctgtcagcaaggatatctacccaatgatcaaagcagcttactattatagtaagaattcagacgaatcctttgatttagccattggtccgatcacatcactctggcatattggattttccgatgccaaggtgcccactcaacaagaaattgataagaacgttaagctggtagactacaaaaaagttaaattaaatgacaagaaacggaccgtttatctagaagaaaagggaatgcaactagaccttggtgggattgccaagggttacatgaccgatcaagtgaagacgtacttattaaatcatggggtttcaacggccattattgacctcggtggtaatatttatgttctgggtgacagccctaaaggaacgaagtcaggtaactggacagtcggtatccaagatccaaaagcgtcacggggtacggccattggctcactacctgctaagaataagtcaatcgttacttctgggatctatgaacgctatttgaagaagaatggtaaagtttacagtcatttgatggacccacaaacaggggcaccttatcaaaacaatttgatgggcgtttccatcatctcgaagaagtcggtggatggcgatgcactatcgacggccacctttgacaaaggcctcaaaggcgggatgaagtacattaatggtaaagcggatcaaggtattggggccatttttattaccaaggataaaaaagtatacgtctccaataacttgaagaagcagttcacgctgtttggcgatgctggttacaaatacgggccagccactgatttaaagtaagattggacgtgaagttcagttactacaagttccgtcagatatgttatgataataaccatgaattttaaggaaatgagggacaatggtgagtccgattattgacgttaaacatttagattatcgttacccgcaacaagctacggatcagttaacgttacacgatatttcatttacggtcatgccgggtgaatgggtcgccattgtcggccataacggttctggtaagtcgaccttggccaagaatttaaacggactgttagcaccagcggccggaacgattacggttgatggtcaagtattatctgaagaaaccgtttgggacattcggcgcaaaattgggatggttttccaaaacccagataaccaattcgttggggcaaccgttgctgatgatgttgcgtttagccttgaaaaccagggcgtgccgcgttccgagatgctaacgcgggtacaagcggccctagaacaagtcaacatgcaggattttgcgacacgtgaaccggcacgtttgtcaggtggtcaaaaacaacgggtggcgctggctggtatgatagcggcgcggcctcagattttgattctggacgaagcgacgtcgatgttggatccccgtggtcgtcaggaagtattgacgacgattcgcgacatgaaggctaattcagcgttaacggtcttgtcaattacgcatgatattgacgaagcggccagcgctaatcgggtcttagtgatcaatgacggtgaggttaaggaagaggggaccccagcggaaatttttcagcatggagaagccttaattaagatgggattggacatgccatatgctgagcgcttaaaagcagcgctaaagcggcagggtgttcaagtgcccacacaatatttaacagagaaaggaatggcggactggttatggcaattacgttcaaacaagtagattttacttaccaaccgggtacgccgttcgaaactaaggcgttaactgatattaacgtcaccattcccaccggctcttatacggctttgattggtcatacggggagtggtaagtctacacttttacagcatttgaacgccttactcaaaccgactagtggaacggtcacgattggtgaacgggtcattacgccaacgacgagtaataaggacttgaagcgcttgcggcaacacgtgggcatcgtctttcagtttccagaaagtcagttgtttgaagaaacggtggccaaagacattgcgttcgggccccagaactttggggctagcgaagcggatgctttgaaaactgcggctgaaatgttggctttagttgggttagacgagtcgttactgacgcggtcaccgtttgacctctctggtggacagatgcggcgagtggccattgcgggggtccttgcgatgcagccacaagtcctagtcttggatgaaccgactgccggattggaccctcagggccgtttagatatgatggagatgtttgcccgtttgcgtcatgaacgtgatttgaccgtggtactagtgacccatcagatggatgatgttgctaattacgcggataatgtaatcgtgatggatcgtggacaaatcgtcaaaacggggacgcctcgtgagatcttcaaagatcctgcgtggctaactgcccatcaactgggcttaccgaaaacaacggcctttgcgcatacactccaaaagcaaggctggcaatttgatgagtggccgttgaccgaggacgaattagcagcagccatcgtccaacagttgccaccgaacgcgatgggggaggtggccgctcatgatgaataaattgatctttggtcgctacattccgggagactccgtggttcaccatatggacccccgggcgaaactgttattgagtttttatttcattgggattatttttattgccaataactgggcgacctatgccttgctatttgtctttacattggccgctatttacctatccggtgtgaaatggtcgttcttcatcaacggtgtcaaaccgctgatttggttgattttattcaccgtcatcctgcaagtgttgtttagtgcaagtggcgggcacgtttactttcaatggggcatcattacaatcagtcaacttggattgatcaacggggtctatattttttgccggttcgtgttgattatttttatgtcaacgctgttaactctaacaacgccgccactggaattgtcggatgccatcgagtatatcttgatgccgctcaaagcggtccgttttccagtctatgaagtggcactgatgttgtcgattgccttacgctttgtgccaacgttgatggacgaaacggaaaaaattatgaatgcacaacgggcccggggggtcgactttggtgagggcaatatctttcaacaaatgcgtgccgtagttccgctgctgattccgctgtttgtcagctcattcaaccgggctgaggatttagcaacggcaatggaagcacgtggctatcaaggcggcgagggtcgcagtaagtaccggattcttaagtggcaccaacgtgatacgtgggctaccggatgctttgcgatcttgaccgttgcattgattttcttgcgtgcataaatgaagactgattaacgtgggcgtcgcactgatggcgacccacgtttttaactggagggatattgtgaccacgcggtataaagtagttttagcatatgacggcaccaattttgcgggctttcaacgccagccacaccagcgaactgtcgagcaggtcgtcactaaggcggtcaataagatggcgaaagatcccgttgaaccgattgtgatctacggcgcgggccgaacggatgctggtgtgcatgcgtttggacagacgttgcattttgacttgccgtacgaaattaatccagaaggggttcggcgcggcctgaacagcatgttaccgatggatacaatcgtaaaggccgtttccattgtgccgaatgattttcacgcgcgttatgatacggtcggtaagcggtactggtatcgggcctatcaaaatgaatttgtagatccatttaaacggcactatacggggcattttaagttcgctgcggatatcgaccgaattcagcaagccatcggtgacttagaaggacggcacgatttctcgaccttcgttgcgtccggttcacaagcacatgaccatgttcgtgagatctattcagccaaagcgtgggccttgccggatgaacgcgaaattcagtttgaattttgcggtagtggttttttatataaccaggttcgaatcatggtggctgttttgatggaaattggtcagggccggcgcgcagttgactgtattccagcgttactagcggctaaggaccgtgagcaagcgcggggaacggctcccgcggctggactttatatgaaaaaagtgtattatgaacaaaatgaattacaagctgatttgataaagtattgacttctgaggcgaaattaggtagactagtcgttggtattgtttgccccacgataagccccggaaatcttattgagtgtcaaacaaacacagaaaatggaggaacacaacgtgcgtacaacatatatggctaaaccaggtgaaattgatcgtaaatggtatgtagttgatgcaaccgatgtacctttgggtcgtctttcaactgtcgtcgcatcaatcttgcgtggtaagaacaaacctacctttacccctaacgtggatactggtgataacgttatcgttattaatgcaagcaaggtcgctttaactgggaagaaagcagaacggaagatttattatcatcatactgcttatgctggtggtttaaaggaacggactgccggtgacttcttggcaaaggaacctactaaattgattgaaacttcagttaagggtatgcttcctcacaactctttaggccacaagatgggcttgaagttgcatgtttatgctggtgcagaacatacgcaacaagcacaaaagcctgaagttttggacatcactaacttaatctaaggaggaaactacattggctcaagtacaatatcgcggcacaggccgtcgtaaagattcagtagcccgcgtacgcttagtaccaggtactggtaaaattgttatgaatgacaaatctgttgaagattacattccatttgcagatattcgcaaggaattgttacaaccattcgaagtaactgaaacaactgatcaatatgatgttttagttaacgttaatggtggtggcttccatggtcaagccggcgcaactcgtcatgggatcgctcgggcattgctcgaagttgacccagatttccgtactcctttgaagcgcgcgggtctcttaactcgtgatgctcgtatgaaggaacgtaagaagccaggtttgaagaaagcccggaaagcttcacaattctcaaaacgttaatattatccaaaaacgttgttttatcaacattttctggctatatgagaaagcacctgtctatggacgggtgcttttttttggttgagtgagaaaaaaaccacaaaaaaaccatatgacgtggctcaacgagataaataacccatttgggcaggttttatttgatactaattggttcgaatatagcccgccttgaaacaaactaagcaagtaacgctcggttacttaaaaatggattgggccattgccggctcaatccattttaattactgacgtttagttttaccaaaagagaagacggcaacgcaaccgaggccggtatggctagtgatagtcggcccaatgtgttcgagcaaaatttcagcatcagggatcttggctaaaatcttttcacgaacggtttgggcggcttcctgagagtcgctagtggcaatgataatgcgcggcttggtctgatcacgtaaatcggctagtgtgttgttaactagtgtggtcagtgaccggcgccgtgagcgcaccttttgtactggacgcaagtggccgagtgggtcgacgtccatgactggctttatctgtaagagtgatccaaccgtcgcggaggtccgtgagacccggccgccgtgataaaggtaatttaagtcatcaacggtgaaccattggtgataatagaggcggttttcagtcagccaatccgccaattgggcgatcggcataccagcatcgcgcttgtcaatggcatctagtagcatcaggccttcaccgcagcaggctgctcgggaatccacgaggtagatctcggcatctggctggtcttgtaaaagcatggccttggcctgttgcgcattattgaaggtcccacttaagcctgatgaaaagccgaggtataggattgtcgtatgtgcctgaacgtacggcttgaaaaattcaataaactggccgatattaatctgagcagtagaaggcatcacaccgttaccaatccgatgataaaagtcagtcaagtcaaagtggtgacccaaatcgtccgcgtattcctggtcgtcaatcgtgacgttcattgaaacaaaatcgacatgcttgtctttaagtagttgataaggtaaatcaacggttgaatctgttaatagctgatacatagttttctcccttaattgtacttactgttacattgtacgcttatttgggcggccatggaaaattaatacatgctgtatttttacgtacagcagtaatttacggtaacaactagttggttgtcgcaattctggtagcagcgtgaatgctgatcaggaaattgaactgggcatgtcagtaaatactggacgcatcggaaggtcagttatgggttaactgcaataatggcgtagtgactaggaccgtgcttttcagtcatggtgatgaggttcgacgactaatttgcctattcaatgaggcgctgtaagttgattgaaatcagccgatcaatggcgtgattttgctgctggcggtagggggggccggtttcataaaggagttgcgcctggtgatgatgaacgctgatctgttcgagttgcggaggcaatcgaagaatcgcgataccggtggtcagttggtgctgttgaattaattggctgcgcttgaatagcagtaagtgtgaggcgctggggccgtatgactgtgataataagacgtagtggtcatagaaggccattccttgaatattaggtgggagcttgccgtgccagtcactaactgcctttggtaaaatggcgtgactcgtggtcattctgtatggcgtgccggcgctcgtcagtggatagcgggcaaccaaggtggtctgtccaggtttgaactggccgacataaagggcctgatggtgataggtcagtagtgaagcattgctcagtgttggcagtgaccagcgttgctgatagtgaacggcaatggaagtggtcgggtcgaagtgccgtaatgcggccagactaacgctcacgatagccccatgaccgtggcgatgactgcacaaccaaatccgctggtggtgagggtcataagctagaccacccacatgtggtttaccatgcaataagacagtgttgcataattgatgttggaaacgatcctgtacatataggacagattgggttcgaccagtggcatcgtaagcggtggttagacgataacgaccggcaataacaacgccctgtggaatcatcattgtcgtcgtcgtgagttgtttagtgacgaggtctctagtcagggtggcttgtagtcctggctgaatggtggtgccttgcaacataccgattgggtcgaattttgctagtttaaccagatccggatactgacggatggtttgataaaattcggttggtgaaaaaacagcttgggtggctgttctttgaagggtggttggtgggtacggtagtgtcggtcgtacgcgactagctagaccgccgagggggtggccccaaattaacaagcccgtgattagtcctgtataaaaatgataggtataacggtgcatcgcgggtccctcctctagtttaagtgttttcaatatagcatggaaagacaggccgcttagcggatagtgaaaggttagttaaggaaagaaactgagtgggacataattgaaaaattaacgtttaacacatctaattttaattatatttacataaaacattgaattttctaattcacaatcggataatgaacgtgttcaagctgtttaacaatctgaataaagtgtgatatcccggtgctcgccaagttaggcgagtgctggctgtcaaaaacggaggaaaatataacgatgcgaattagtgcggaaacggaacgacaatttttagaagcagtttttaaggcccaacggtttagtgccaaggatggggcactgctggcagacaccctggtcgatgcagatttacgtggaatctcgtcacatggtatccagcggctggcttggtatacgcggatgatcaaggatcataccttggaaccgacgcatcaaccgaagattttgaatgaaacacctaccagtctattgatcgatgcgaaccagagcatgggccagattgcgtcggcgtttacgatgaataaactgattgaaaagactaagcaactcggtgtttcattagcggttatccgcaattcgaatcactttggaacggcgggctattattcgcgcatggcttgcaaagcgggtttgatcggtatttcaacgactaatacgcggccgttggtggtgccgacgaatgcgacagaagcttttttgggttccaacgcattagcttttacttttccagccgacccgcatcctttcgtttttgacggcgcgactgcggtggtttcgagcgggaagattcaagtgctggccaaaaaaggtgcacagattccgggtgattgggcggttgatgagcatcgtcaagttttgcatgatgcgcagacggtggaggataacttggctaaaattgcgttttctgagaatcgtcctggtggtggggtcctgactctaggcggccagcaggaagtcaattcaaattacaaaggctttggcaactcactaattattgagttactcacgggaattttagcgcaagggtcgctgtcggctgatacgaacaccggtaagcatgactttagtcagttcttcatgacgattaatcccgccttatttggcgatcccgaggtgttgaaggccaacgtgacgactatgtttgaccgtattcggcatttgaagcatctaccaggtactaagatcatgataccaggtgaccgggaataccggcactatgatgaaaatttggtgcagggcgtcagtattgatccacagacgttgacggaaatgcaacaagttggtgctgaatttggagtggcagtccccgcagccttgaaagcgtagtttagtgtagttgcggcaattattgtgactaaaatggggatcacataaactgatgatagtgtggctggaatctgctctggatgctggcgacactattttgggttatcacgattatgtgcggtggtgaagaccagctagctggttgggaatagatagcggttcagacaactggcgagcggctaaggttagttgctaaagcatacggaacattgttgaagttgtaatcgaaaatgaccgtttgtcagtcgttcgttgtgagaaatttagcgttggagtgcggcttttagactttaatgatttgcctggcggtggattataagttaagtcagtgcaagctactggctaaaaatattttcagaaagtggcagggaaccattttaatatctgtaaaatgatttgacacgcaaacttgttgatttaccagtatttattagcagttagcgaggatgatgacgactagcaaatcgagggtggaccaacgtgtttttgttgattaatagaaaaagtttgcaaaaaccatttgacaattctattgattagccgtatattttaagtcatcaaatacacattataaattaaggagattttaatcatgacgattaataccaatttacaattgaattcgtattattattactggtttacttagtgccttggcatccactgcgaggcacgccctcgcaacggatgtgaccagtaaattttggaatgattaaaatttatggaaaagtcatatcagtgttgtgaacaaccactgtgtgacttttctgcttctgagtagcggtgtttttcgggcaccctgcgaagaattagtggactcacagttggtgtaactgtgagtcttttttattagccaaaatgagagggagcgaagttaatgcaagcatttgatgaaattgatgaattagcggtgaataatctacgagtactgagtgcggaaatgattgaacgggccggttctggtcatccaggattgccactcggcgcggctccaatgatgtgggcactgtggagccgacaattacgggtcgatccacagcagtctcaatgggctaatcgcgatcgctttgtcttatcagccggacacgggtcggcgttgttgtacagtctgctacatgtgagtggcttcaacgtgacaatgggcgagttacaacattttcgtcaattcggcagtcacacgccaggccaccctgaactgggaatcgtggatggtgtggaagccacgaccggtccactgggacaggggttagggatggcggtgggcatggccctggctgaacggcaactagcggctcagttctccgagtcaccgcagttggtggatcactatacttatgcgttagtcggtgatggtgatttgatggaaggcgtctcccacgaagctgccagctttgccggtaatcaacaattgcaaaaattaattgtattgtacgacgataacgctgtttcgcttgatggccccaccagccggtcgtttcgtaccgatgtgaaccagcgcttcgctagttatggttgggatacacaaacggtaggtgatggcaatgatttaacggcgattaatgccgccattgagcgtgccaaacacagttcacgtccaagcctgatcgctgttaaaacgacgattggatttggcgcaccacaagcgggtacgaatgcggtgcatggcaatccgttgggaacggccggtttaactagtttgcggcaacaattagggtggcaagccgcgccatttacggtaatgccggccgttgctaaacgcgcacagcaactaatcttgcaacgtggtcagcgtgcacattgccggtggcagtcacaacgagaggctttaccacaagccgtacaacaccgtttcgaacaacagctcagtatgcgtctgccagttgacttagccaccagtttaccgatctttgatgaaggcgcccaagcttcgcggatcacgagtcataccgtcattcagaagctagctgctcagttaccaggattagtcgggggcgcggctgatttagccagttcgaataagacgaccattgagcaggatcaattgtcgactccggtgaccccggatcagcgcaacgttgcctttggtgtccgggagtttggtatgggcaccattttgaatgggatgactttacacggtggcttgcgggtctttggtggcaccttccttgtcttttccgattacacgcgtgcggctattcgattggcggcgatgatgaagttaccagtcacttacgttttcacgcatgactcgattgcagtcggcgaggacggtccgactcatcagccaattgaacagctaatgagtttacgattgattccgaatctaacggtgatccggcccgctgacccgaatgaaacggtcgcagcttggtggcaagccatcaacgcgacggatcatccaaccgtgctcgtcttgacccgtcagaatttggcagtgctatccggatctaagactaaggccatgactggtgtggctcgtggcggttatgttctctcaccgcagcgtggccgccagccaatgggaatcttgattgcaagcgggtcagaagttgctttagctcttcaggcccaggcgaaactagctacgttaggtgaagatgtcagtgtcgtttcaatgccgtcgatggaaaactttgcgcgccaatcaacgaattaccaagctcaggtcttgccacctcaaattcggcggcgagttgcagtcgaaatgggcgcaacatctggctgggaacgttacgttgggttagatggggcggtactaggcttggaccactttggcgccagtggagcggccgaccaagtattagccgctaaccagttcacggtagcagacctagtgcggacgtatcaacaaacgcacgtggatcttggtcaacaattgcgagtcatttagaaaggaagttagttaaagcatgattgatggacaaacggcactctttggatttatcgcgcaccccgcgcggcacagtcgctcaccgcgaatgcataatttgagttttgactactgggggctaaatgcgcgctacttggcgtttgatgtggcaccggatggattggctgatacgcttgctggaattcgtagcatgggtatcgcgggggtgaacctttcaatgccattcaaacaagccgttgtaccgctactagatggtttgacagtgcgagcgcaacggattcaagcggtcaatacgattaagaatgaagctggcaagctgattggtgacagcacggacggcgctggagtttttcaggatctcttacatcaaggtctgaacttggttgataagcacatcatggttttaggcgcgggaggcgcaggtaaggcaatcattgcggcggctttagattatggtgtcgcgagtgtaacggtctttaaacgcaacaacgaacgctacgccggtgttcagcactggttggagcaactcagtaccacgacttcggtaccactccggctctgtgcctatgaagatcaagtacggatgcagcaagttgctcgtaccagcgatttgatcattaacgcgaccaatatcggcatgacgactgctggaacgccattaccaatctcaattatccagcaattagtcccacaacagacggtctatgatatgatttaccaaccgcttgaaacgacttttttgcgcttagcgcgtcagcaggggtgcgccacatataatggcttggggatgttaatttggcaaggtgccttggcttttgagttttggactggtaagcagatgccagttcaacaggtccgccaagatatgttagccagtattcaagcgactccgccgattacggcgcaggcttaggccttaacttttgagaattgattagtaggaggaaactattatgattattatattaaaaccagcaaccgctacggctatgcaggcaaagttagtgagtcaatttggtgcggatcacgagatcttcacgcacaataatcgaattgcaattcaaggattgcgtccagaagcacttcccacggatgtgcaagcagccagtgaatcaatcttgacggcagttcccgcagcggtccaaagcagccgtctctttcacccagaagatacgattattaagacgccacacagtgtgattggcggtaatcaattcgtcatgatggctggcccgtgttcagtcgaaagcgctgaacacgtggaccagatggccgcggttgccaagcagggtggtgcgacgattgttcgtggcggagcattcaagccacggacgtccccttacagcttccaaggcctcggggagacgggactccaatacttacggacggcggctgataaacatggccttgatatgattaccgaagtgatggatgatgaacacgtggcgatggtggcgaaatacacggatatttttcaaattggtgcacgcaatatgcaaaatttctcgttgcttaaagctgttggacagacccaaattccggttgcattaaagcgaggaatgtcggcaacaatcgacgatgtgctcaatgcagctgaatacattgcagctggtggtaatcatcagatcatgcttttggagcggggaattcgaacgtttgataataagtacacacgcaacacgtttgacttaggtgcagtgccagtcttgcaatcgttgacacattacccagtcatcgttgatccgagtcacgcggtcggtacctgggaactcgtgaccccgatggcgatggcaggtgtagcagctggcgccagtggcatgatcgttgaaattcatgaccagccaacgcaagctttatccgatgggccgcaagcgttaaaacccgcgacgtacttaaaaatggcgcaacaggctttccagttacatgacctgatgcaaacgtgggcgtaggatgtgcctatgacaaacattgaagtcaagacgcgagttaaacagtatcagatcaagatcatgattgacagtttacatcatctaggaacgttggtaactaaggtatggtgtgcccgtcaagtagcggtggtaacggataccaatgtgggcccgtactatgcgaagctggtaactgatgaactgacggcggctggattcaaggtgcgtgtgatgacggttccagccggtgaggcgagcaaaagttggtcacaagtccagtcgttaatcgatcagctgagtgccgcccattttagccgcagtgacggtgtcatcgctcttggtggcggggtggttggtgacttagcagggtttgtcgcttcgatttatatgcgcggtattgccttgattcaagtaccgacatcattattagcgcaagtcgatagttcggtgggcggtaagaccgcgattgacttaccaactggcaaaaacttagtgggcagtttttaccaaccagatttagtcgtcattgatccggcaattctggtgacgttaccgccgcggatgctcgcagaaggttatggcgaaatcgttaagtgcgcagcattagttggcggtgatttttggcaatccttgcaacaaattaccagtgtggcagcgattttaccagcagcaccagatttaattgcagctagtgtggcgttcaaagcgcgcgtcgttatggcggatgaacatgaacagggtcagcggcaattattgaattttggtcatacgattggtcacgcagtcgaactattggctgacggtcaactaatgcatggggaagcggtagcgattggtctagtacaggtttgtcggttgtttgcagcacatgggttagcgccgactagtttaacgtcgacgctcaaggcacgcttaatggcggtagggttgcccacggaattaccgccgatagcgccgcaagccgtggccgcagtgatgcaacacgacaaaaaagtgcacggtacagcgctgacctgggtctacttatcggcggttgggcaaccccacctgtatcccatagcggtcacggacttggcgacttggatgggtgacttgtggtcggtgtcgtgattagacgtaagtttacaatatgcttcagttcgacacatgacggttagccgggtgggatctgaaaatttgagggagcatcagaacttttgacgtccaggttctgatggacttacatggtagattaacaatcggctttccaagtaatagttggaaagccgattgttattggttagggcgtgatgtttgtatgatcaagtcgttagtcaggagtaagttcacattgtgcgcgttaattttcatgaagcatgcattaaaatatgccagtcttgagtttaaaaagccagtttagggtcaccggcaaaagttctgatttgcgtaaacttgctcggctagatcgtccttcccccagaaatgggcactcagcccggagtcgggaaatacgtgaatgagtgtctgaacctgtcaaatggtatagttgaaaaacaactagtttaccaatagcctaaaagtttcatccagagtgtgccaccaacgccccatactaatagatagaaaccaccaaggcacagattcagacgccaccattcggactgcgttatgtaacctgatccgaacataatcgaggcgggaccgttggcgtaatgggtggtcgaactgaaaatggcaccgtcaaagcctaatagtagggctgctagcattgggggggcgccggctgaaattgccacacccaagaaggcgccgtacatggcggagacgtgagcagtggcgccggcaaacaggtagtggctgtaaaagtaaacgagcatcaaagctgccaagacccatagccaactgattccttgcagggcctggcccatagtttgtgaaagccatggaataaagccaagactgttcagtttgccagccataaaaataagaattgaaaaccaaacgagtgtgttccaagccccagtttcatgtaataagtcgtcaacggataatacaccggttaataagagcaaagtgacggctatgaaggccactaaggtcgcgtctagcccagtgagactagctgagatccaaagaaagagggccaacataaaaataccgcccatgagtttttcggccaaagtcatggcccccatctgctcaagttcgttggcagcccacgcatgcgcgttgggtgtatccttaatttctggcggatagagccaataaataatagctggaacgctaattaagcaaataagaccaggtaatagagcggcgagtaaccagtccatccatgtgatgtgaatctgcattgcttgggccaaggccacggcaacgagatttggtgccatcgcggtcatgaataagccactggtggcaatattaccatggaaagctgacataatgagaaaactaccaaccttacgctgcgtaccgttttgtgggtcagagccgtatgctttagctaaagattcaataattgggaagacgattccaccggcgcgggcggtattgctaggcgtggccggactagtgacgagatcgacaccaatcagcgcgtaggctaatccaagggtctttttaccaaataatttgacgaagaccagcgcgactcgtcgccctagccccgtttttacgaagcctcgtgataggaagtaagccattgcaatcatccaaaccgtgttatcaccaaagccggccatggcatccgtcatcgagataacaccaagtaagacaccaagtgtgagaccaataattgcgacaccggcaataggtaacggctgggtaatgcaaccaatgatagtgccaacaaagagagccagcatgtgccatgctaatagactgagccccgcgggacgaaatggcgcgctcagccaaataatcaaaccaattatcagcggccatgtaagttgctggtagttgacggattgtaatttggtcatcgaaaacgaccacctttctagtcaaacgttaaaatcgtctcacggtgactgctgaaactagtcagcaaatgatgttaatccggacacgatttctaaattagaattaatgcaaccctaatgtcatttttgctgcccgtgacattttatcaagcgaccaggccggttcccagacaaggttgatgagtacctgatcgatacccgcgacggtcattaatgcgcttttgatatggtcattcaaatagcctgtcagtggacagcccatgatggtcagtgtcatggtaacggtgcagagctttaggtcagcatcgtaagcaacatcgtagatcaaaccgaggtcaacaatgttcacaccaagttcaggatcgatcacggtactcagagcggctaaagcttgggtttttaaagtagattgtgtatccatactaatcatgagaaagactcctttagaccaacagcctaagcagggtgatccgcttaggctgttaatggtcggttatttaatgaatttaacttgttcgttgatttttttaatctcagcttctttacgttcgttgaagatgaccttgttcttttcaaacaagttgtcgccattcgtatcgatggagacaattaacggaccgaagtctttgacctcacacgcccagagtgtttcgggcattccgaggtctttccactgggcatcaacaatcttattgacgtgcagggcggcataaacagcattgccagcggggtagacgaggtgtaaggcgtgatatttcttgcaggcccgttcggttcccggtcccatgccgcctttaccaacgattagtttgacacgggtttgttttacgaattcttcttcaaatttttccatccgcatactagtcgttggcccgactgcgaccatttcgtacttgtcatggccgagatctttaatgatcgggccagcgtggagaattgctcggtctgtcacgttaacgggtaggggacgatgttcttcgacgagccgccgatgggcaacgtcccgacaggttgttagtgagccattcaagtagacgatgtcgccgatacgaatgtccttaatatcgtcatcagaaattggggtggttaagtggtaagttttcatgataattcgactcctttgttcagtggtaagtcatagtttagatctgcgtcaaagttgataagtccgcgccggtgtgaccagcagccggtactaacagcgacgccaattgttgatgggtgtcgggcggtattctcgacattgacacccattactgacttttgaccgccaaacccctgtggtcccaggccaatgtgattgatgccgtcttctaataagtgttcgagtttggcagcattagcgtttggattttcactatcgacgcgccgcattaaagctaatttagaattaagcgcagccgtttcaacggatgtggcgacgccgacaccgacgagtaaaggtgggcaagcgttaatgccgtagctcgtcatgcgatccatcacgaaacggacgacgccttcgtaaccttcaccaggcatcaggactttggcagccccgggtaatgtgcagccaccgccggccatgtacacgtacattgagatgtcagtgccattaccatcaacttgcagaaaaatcgaggggatgccgtcaccaatgttcataccggtattgtattcgtcaaatgtctgaacagcattatgtcggagtggcgctttttttgtcccacgataaacggcgtctttcaaaatttgattgagttcgcctaatagtgggaactgcgcgccgcatttaatgaagaattgtaatgcaccggtatcttggcaacttgggcgtttaagtttattggcaagtaattggttttccatcatcgtgtcgtagacgagcttttggagtggatcgacttcgatcttactgagttcttcgagtttggcagtcacatcatctggtagtcgatgactgatgagtgcaatataatcggccaaaatgtcgcgcatccgttggcccttagttgataacgttggttcggtatagttgtatgtcattgtatccatagctggtttcctcctatcaatttacagctacattgtaagtaactgtgtgatacaaaactaaccgctactcgccaagttatgccaggtatcagattgtgaaagtgatggtaagcggacaggtagccggttaaaaatgacaaaaaaataccaaggccttctgacgagtgatgccgtcgtaccttggtatgacccaatatttgatcaaaatatcggtaagttcagttgttcgtaatcacaaaaattgttatgccattaattattgattgagcagtgtttttaattgcgcgattttttgtttgagcgcctgatattcttgaaaatgtagtttatacatgcaactttcacaagcactgagttgatcagtacttgtgagttgggcccagtgattgagttgcttttggacaatggtagtttgtgtgggagtgagcggttgcttgaactggtcatattcaggacgctgcccgtgtgacaagtgttgacggtaactggaaggtgtctgaccaaaatgcttcttaaacattagattgaaggacttgacctcctgaaacccattggctaaggctagatcggcgactcttgtggttgggttttccagatcgtagatggcgtgttgtagtcggcagcgggttagatattcgtaaaaattcaggccgagttccgctttgaagatgcgtgagagataggctggtgaatagtgactgatttttgccgcttcgtttaaggtaattggtcgatcgtaagcctggttaatgtaatcaatgacccggtttagtgaactctgcgtcttgggttggggataagccatcgtgattccagtatcaaagaaatcgtgatgtagcaggttcgtcaattgaaagtacagggcgttcaagtcaaaaattggccagtcctgctgatgtaatcctagatagagttgtgccaggatttggcgaatcgtttggtagtcacggtgttggggcgtcgtcacgctgttgagtagaaaagcacctgaactgaggtcgatgccctgattagtgtagaagtcgggcagaatatgtaaacggagcgcgatacattctggggtcaaggcaaaggtggcatggccgcgattggcattgatcaagatgaggtcatttgcgtgtaattgatggcgagtcccgtcaacattcacttcgacggtaccttgcaataaccataagagttcgatttgcggatgccagttgtagtggtaactaccaatcatgtatgttaataagtcaaattggacggttggggtggattgaaaatgctgactaggtatcatgacagggtcctccttaggaataactttgattagctctagcttacacgttcagaagatgcttgaacagcagtcgacaaaagaatacaaagaaaaatgacaaaaattgactagtatcagttatgatggaaatataagtaatggtaactgaatgttggttgtggtcacgcttaatcaggactgaaagtgacccaagcacatcatcgttgttagactaaggatgaaatggtggagaaatagtggatacgaagataattgtcaatcatgcgctacgagcgcttttatacgaagtgacggtcaaccctaagcccgggctggtcgatccgttgtcggcgggcccccatccagacatgaacgcttttatgtttattgatagtgctttgagtctagccccctactttaatgcttgtgcagcggcgggcgtcgcgtatacggctgtcgatttgacgggtttgttcaagcaaattcggggcattggtgttcaagcggaacaaaccatgtttgcggcgaccaagggcgtgaatacccataaaggggcggtgttctcactgggcgtgctagtgacagcggcggcgtatcagttgcagcaccccgacgtcgacttagcaacgattgtgcgcacaatgctggcggggttaacggcaaatgattttaatgatttaaacacgaaggatccaacgaccttaactgctggagaacgtcaatacttaacatatggcatcaagggaattcgtggtgaagccgaggcgggttatccgaccgtgatgcaagtggcactacccgcattgaggcgtagtcgtggcacgattaatcagcggttattagacacactgatggcgattgtccaggcgacggtcgataccaatctggtaaaacgggcacacgacccgcacgtcattgactgggtccacgaccaagcataccgctacttcgatttaggggggagccgcagtgaagctggaatggcgtttttacgcgaattgaatcagatctttgtcgaccataactatagtttaggtggctcggccgatttgttgattttgacgatttttattgggttgcagacagatatattagcttaataatgagtgtcgtgattgtaggtgacgacacttttttaataccaaatattaatggaaattaaatgacgattgcaatgcttagttgatgagtggtcagtgctttttagtggtgatggcatcgaaagtcgtttcagtaggttctggattaagcatttagtatgttggttgtaacgccttggttaagcagaaatagtattagaatgaacgaaaatttaataccaattataaaaaagttaactgtacctaacaattatttgcattagcgttaattatcagttatgcttatgacgatgtagaaaaccgactaccgcgatgaacggaggaaatgtgatgttaaaagtacaaaacctcaccgtggcatacagtgacacaccagtctttactgatgttgccgttaactttaacgccggcaaaattactggaatcattggtcccaacggtgcgggaaaatcaacgatgatcaaagcaatgcttggtctgatcaaatcccaaacgggaaccgtcgaatatgaaggtcgtgcgctaaaacaatttcaaaaacagattgcatatgtcgagcaacgtaaagatctcgacttaacctttccaatcaatgtttttgacgtcgttttgactgggacctatggcaaactcggacttttccgtgaaccaagcaaggcggatcgtcagcgttgccaagatgcacttgagcaacttgagttagccgatttagaacagcgccaaattagtcagctctctggaggacaattacaacgggtctttgtggctcgagccttagtccaagaagccgatatcattattcttgatgaacctttcgtcggcattgatttacagagtgagacggctatcatgacgatcttgcatcagtggcgtgatgccggccaaatgattattgtcgtgcatcatgatttgaacaaagtttcacgttactttgatgatctcgtgattttaaatcacggtatcgttgattatggtcccgtggacgcggtctacacacccgcaaacattgaacggacgtttagtgctgatctttcggccgtcctgtttacgaaggaggaaacgcgatgatgcaatcaattacgacctttatggctgctttggggaagtatgatttcttacaaagtgcgctaattacggctattatggtcggggtcatgtcaggaattattggtagctttattattttacgaggcatgtcgatgatgggcgatgccatctcgcatgctgttttacctggtgttgcggtagcttatatgctcggtatcaacgtcctaattggtgcttcggtttttggaattctagccgctagcttgatcggattcgttgcgagccgtagtaagattaagactgacacctcaattgggattgtcttcagtgcgttttacgcactcggttttatcctaatttcattagctgaaagttcgacgaacttgcaccacatcttattcggtaacatccttgctgtgagtgatactgatatgatgacgacgacggtcgtgttaggactagtgattttattcgtggtcttcttctacaaggaattactgattacgtcatttgatccgacctttgcgaagacttatggtctcaaggtccaactgttacattacgcgttaatgctggtcttaacgctagtgaccgtttcagcgctacaaaccgtcgggatcattttagtggtcgcgatgttgattacaccggctgcgacggcctttctatggacagaacgactggcagtcatgcttggactgtcagccttaattggggtcttgtcctcagtggtgggcttatatctcagctacacgttgaactgggcttctggtccggccatcgtgctagtagcggctattttcttcggtatttctttcatcatctcacctaagcaggccttgttgccgacgctttggaaagggcaagcagcagcgcgacgggtgacagcatgaaaacgaaattaattgcactgattggagtcatcgcgatggttaccgggatggcagtatttctgaatcaacgccagcaaagtgccaaagcgacgaccactagtgccaaaatccgggtcgtaagtacgaactcgattctagatgatatggtgaaaaatgtgggtgggcagtacgtccaaaattacagtattgtgaagcgcggcactgacccgcatgagtatgaaccacggcccactgatattgcggcaactgccgaagctgacgtgattttttataatggcttaaaccttgaaactggcggtaatggctggtttaaaaagttagtgacggcttccaaaaaggactttgaccacgatgtttttgcggccagtaagggaattaaggtcaaatatttaacgacgaacgttaatgagccggacccccatgcttggttagatctcgccaacgggattcaatatgtcaagaacatcaaccggacgttgcaggccaaggatcctaagcacgccgctgtttatcaaaagaatacggatcgctacgtggcaaaactaacaaaactgcatgagagcgctcaaaccaaattcaagcagatcccgacgagtcaacgattattagtgacatccgaaggcgcctttaagtatttctcggcggcctaccatgtgcccgctgcttatatttgggaagtgaatacggaatcgcaaggcacgccagctcagatgcggacggcgttgaagaaaattgaaggaacccaggttcgaagtttgtttgtcgaatcatccgtatcaccgaaatcgatgaataagctttcacaggagacgggaatccccgttgctagtacgatttttaccgattcgctggcagctaaaggcaaaccgggtgatacgtactactcaatgttgaagtggaatcttgataagatttatgctgggctgactcggttgtagtacttgggtctataattcggttgtgttgatgtcatgtgatataagtttgttctaaaaaggaccgtggaagttaaatcttccacggtcctttctttattttgaactgctagtttagtcttccgattcgaatgacaattccgtcattgatagttccagatcatcaagtacgtcgttttcactcagaaattgttcccaggcagccggtgtttgttcgcgggtatgggggacgattttatcatgaatattggcaatcacatcatcgagcatcttatccgcttgccgggcgatttcagcatcgttatagcggcgtgctggcgcccggtcctcattttttcgattcagaaaatcggttgctttctccataaaaatggtaataacttgggagttgtttgcgagatagtcttttaaagtttcattatccaatgtattagtcctctctagtttgagtcgtacttctaatataccacgctaatcaggttttaactgtttcaagatcggttggcgggtaaaaagttttgtaacttgcgcagatgtttcgaattgacgccaatcaggcaatttaaacgcaggattgtaaccgcttacgaaaatgatttcacaagccgacactttagaaatagttcacaatcaaaataattttaaatgctgctacgcaggcgttttaaacaacaattatatttaaatttttcaaaaaaataatttatttttaaaaaattagcaaaaatgaaagcatttgcgttataatacttgtgagttaagtaactaagtagttggaaccacatgtgcagcacacatttttgatgaaagaaggatattgacatggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcgtgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcagttgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaatcgcaacgggctccaaaaagtgattgaagctgagctatcagatgatgagcgtgcccggatgcaacatttcgcagccaagatgctgaccatgatgaatgtggcatcataaaaatgatgagtaagtatgaggaggaattgagatgacactaaataaggtcaagtatcgtgattttattgcaccgttattggtgggcctgatcatttggttaagtagtcctatcaaaccagccagtgtttcgatgaacgcatggcatattctggcaatttttgtggcaaccattattggttgtattacgcggccgttaccaatcgccggggtcgcaatcattgggttgacactaaccgtgttattgggcatcgtgcctatggatacagcggttgccggatttgggagcagtacggtatggatgattgcgatggcgtattttatgtcacgtggtttcatcaatactggtttaggtcgacgtgtcgcgttggtgtttgtgcggctgtttgggaaacgaacgttgggtttggcatacgcactgattggcgtcgatttagtaacagcacccgcaacgccaagtaatacggcccgtgctggtgggattgtttatccaatcattcagtcgttagctgaaacgtttggttctgatcccaaggatggcacacaaagtaaaatcggttcattcttagtgttcgcagaatttcacggtgatttaatcaccagtacgatgttcatgacggcgatggcgcctaacttagttgctgtcacgttagccaagagtttacacatcacgttatcgtggatgcaatggttcttagccgggattgtcccaggacttatttgtttattggttgtgccatatttaatttataaaatgtatccaccagaaattaaagatacacccaatgccaagcaatgggcggatgatgagctggcaaagatgggtaagatgagtcttccagaaaaaatcatgggcggcgtcttcttgctagccttagtcttatggatggtatccagctttatcggtctcgaagcttcattagttgcctttatggccgtctccttgctactcgttgctggggttctatcggtagatgacgtgctacacgaaactggtgcttggaataccttggtgtggttctcaattttgatcttcatggctaatgagttgaacaaactcggctttattccatggttgtctggcgcgattggtggtgccttgaaaggcttcagttggggcattgttttagcggcactcgtcttgttctacttctacagtcactacttgtttgctagtgggactgcccacgtttccgcaatgtacggtgccttacttggggtcgcggtttccgcgggagcgccagcaacctttgctgcactgatacttggctttactggttcgatcttcgcttcgacgacgcattatgcgaacggcccggcgagtgttctcttcggttctgggtatgttactcagggaaaatggtggcagttaaactttattttaggtctcttctacctagtcgtttggggtggcattggcgccctctggatgaaagtgattggtatttggtagtctgattttaagcataaaaacaggtaccaagctgccggcaacggtcagcgttggtacctgttttcgaagaagcggattatttggatagtggtgtggcttgatcttcttggagaacccgattcgcgacggcttcatcaatgatgatgtcagtgagtaattgtccgcggagggcgccaagtaaggcttcgctcttgaacttacttttgatgatgccgaaacgacgcggcactttgagaatggcgggcattttagcgccaaagagtttgtcgtggtcggcgttcagaatgtgaccattgatgtcgtatggccgaccgtataacaggccgaccaccgcctgcggatcagcgccacccagaatggcttggcgatgttgatgccagacgggaatcgagtcaatggatgctaaggtgccaattccggcaaatagcatgtccattcggtcaaagttactgatggccggtgtaatggctggttcttgagccaatgcttggtgtgcttgatcattaaacaagtagagtggtgccgggatggtgacgtactgtgcgccgaacttagcggcggctttttgaaccaacggtgttgagccgttcgctgcgttcgttttcaggttatcacccataaactgggtgaacagtaagtcatcacgagtgctcgtttgaaaattatcgatgacgctaaggacagtgccaccccatgccaccccaattacattactttgaatgatctggcgctggattgtttcggcggcaaactcgattacgtggcgttcatcgtcactcgtggtatccgcgtctttgataatataaatatgttcaattggaaaacgatgtttaaatttagcctccagctcactatttcgttcgatgggggtgttaatgttaattttgactaggccggttgccatggcttcgtctaagtattttgaaattagataacgactgacttggtatttctttgaaatttcagcgatgttgattttggataagtaataatcatgtgcaattccaatcaacaggcggcgatgattcatatcgtccatatcgatgacctctttatcaacctaagatttaaaattttaaaactcgtttataatattttaagtttattataccagaaaagctgactttttaaaaattataaaaatccaatctaaatttgatatttttaaaaaatggtcgtacactggggataacaaagtgaacggtattattttgagaagagaaggcagatattgatggtagaacaagatgagattttaaagttgcacgccgcccatacgggggttttggacattcattcagaccttgcagtgaccgataaggctgatttaggtaaagcatatacacctggtgttgcggtgatttccaagctgattgcggcgcatccggaattaaaggcaaaatacacgatgagtggtaaattagtagcgttgatcacggatgggtcagcagtactgggcctcggcaatattggtcccgcgggtggtttgccggtcgtagaaggtaaggcactcctatacaagaacctcgcagggattaatgcgattccgctggcgttaaatcaggtcagcgtgccagcaatggtggcgacaatcaaaaacatatcgctctcatttgcgggcattcatctggaagatattacggcgcctaagtgttttgaactagaagcggccttgaaagatgagcttgatattccggtttatcatgacgatcaggaaggcaccgcaattgtcgtgttggcgggactgatcaatgccgctcacgtagtcggtaagtccttacggcagatgcgcatcgttgtcaacggcgtcggcgcatccgggttagctacagctcggttattagcagcggtcggtgtcaaacaactgaccttggtcgatgtttacggggtcgttacagcggatgatcagcggtacaaccagtatcaacggaatcttgccaaacagttgggaacacctgcacaactaaaggggcaaccactggcgaaggtcatggccgaccaggacgtcttcattggcttgtcagacgccaacgtcttatcagcaggggccgtccacttgatgaatcatgatccaatcgtctttgcactcgctaatccagtgccagaaatcaatccagcagtagctgagaaggctggggccacagtcattgcaacaggttctagccagtatccaaaccaggtcaataatattctggctttcccggggctcttcaagggcttactcacaaatggggtcaagcaagttgataatgcgttgcagatccaagtggctcaggctttggctaagaccgtgtcgaacccaactgcgacgacgattgtgccgagcgtctttgattcacaagtggtaccgaacgtgacggcggccgttgcagcgtacgcgcaagcacagcattaatcataggaggttgtctgatggcagcgcaagttgttgaaatgcaattaaataatccgcacgagcatgcccagtggcaacaattcttaacgtcattagggattactaattttagcccgcaagaggttgaacatattgatgtgaccttaggattgatcgaggatggccaacttgttgggaccggatcgttagctggcaacgtgcttaaatatgtgggtgtctgtaataagaatagtcagccgggggcccggtttaatcaaatcgtgagtgcactggtcaatcggctgtttcaagcacagatctttcatatgatggtatttaccaaggccaagtattcagcgagttttcaacacgtaggctttaaagaattagctcattcggatgaagcggccgtattagaaaacggcgcaccggatatgacggattttgtcaaacagttgccgatgattcccaaccaagcacaacagcgtgtcagcgcgattgtcatgaatgcgaacccgtttacgcggggacaccgctatttagtggaacaagccgcggcggtcagtgatttagtttacgtcttcgtcgttgcgacagatgcgagtctattccgtaaggccgagcgcgttaagctggttcaacaaggaacagccgatttggccaacgttcgggtcgtcagcgggcaggactatctcgtgagtgcagcgacctttccagcctacttcttggattcagcggcgagtgcaattgaagcgcagacgacgttggacgcccggatctttaagcagcaacttgcaccagcactgcacattacgacccggttcgttggtagtgaaccgacgtcgcggacgactgcgatttataaccgagttttgcagcgtgaattaccaccggcagttgctgtacgagtgatatcgcgaacgacggtggctaatcaaccaatttcggcgcggactgttcggcaacggattcaaagcggcaacttaactgagttaaaccaactggtaccggcaacaacggcccagtttataaaaaataacctaacaacattacaagcgcgaattcagaaaggaatgaaaattgatggaaattaagacaacggcagtcgccggaaccttggaatcatctgatattcaaattatgttaatggcgggagacaacggcattcaaatcgaccttgaatcggatgttatcaaacagttcggggcacaaatcaagcacgtgatcacgacgacgcttcaacaattgaatatcgataatgtgaaggtgcgcgctgttgataaaggggcgttggactgcgtcattaaagcgcggaccattacggcagcacaacgggcgttagaaaccacgacaccagcatggaaggtattataatggctgaaaatgaagaacgcttacggcggacaatgatgtttgtacctggtaataatccagccatggtaaaggatgccgggatttacggtgcagactcgatcatgtttgacttggaagatgccgtctcaatggctgaaaaggatgcggcccgggtgctggtttacgaagcattaaaaacgcaagattatggcaacgctgaattggtcgttcgaatcaatggtttggataccaagtattacgctgatgatgtcaaagcaatggtcaaggctggcattgatgttatccgtttgcccaaagtcgaatcggctaccatgatccaaacgttggaaaaggatgtcgcggcagctgaagctgaatttaagataccagttggcacgactcatttgatggctgcaattgaaagcgctaagggcgtgcttaatgccccggcaatcgcggcagcctcggatcgaatgattgggatcgccttgtcagcagaagattatacgacggacatgaagacccaccgttatcctgatggcgcggaactggaatttgcccgtaacatggtgcttcatgctgctcgtgccgctggaatcgccgcgttcgatacggtctttacaaacatggccgatcccgatggcttctaccgtgagacgcggcatattcatcaattaggatttgacggtaaatcattggtcaaccctcgacagattgcaatggtcaattcagtctatgaaccaaccaaggatgaagttattaaggcccaaaaagtcatcgccgcgattgaggaagcccggatcaagggttctggtgttatttccatgaatggccaaatggtagaccggcccgttgttttgcgggctcaacgtgtgatgagcttagccaaagtttccaacttactcgacgaggagggcaattacattgaaaaatagcgtagaccgcgaattaccagcagaattaatgacgaagttaaattaccaaggctttgaatcgaccgatattggtcatcctgaaattcaacgggtggcccccaaagttcatgtttcaacaggggacaacaaagtcgttgattccgttgctgacgtggtaaaagccactgtcaaagatggtatgacgatttcatttcaccatcattttcgtaatggggatttcgtcttcaatcaagtgatgcgggccattattgatgccggtattaaagatttgaccttggcgccatcctccttaacgggcgtgatgaatgatatggtgatcgaagcaatcaaggctggaacgattacgaatattactagctcggggatgcggggctctcttggggacttcgtttcacacggtggtttaaagaatcccgtaatcttccgttctcatggtaatcgggcccgggccattgaacatggtgatattaaaattgatgtggcctttctaggtgttccgaatgctgaccgactaggaaatgcgaacgggatggctggtaaagcagtctttggttccttaggttacgccctgatggatgcgcaatacgccaaccaagttgtcttattgaccgataatattgtggcttatccaaatacaccggcctcaattaaacagacgcaagtcgattacgtcgtgcaagtcgaccaagttggtgaccctgacaagattggttcaggtgcgacgcgcttcaccaaggacccaaaggaattgaagattgcccagaccgttaatgatgtgatcgtgaactcaccatactttaaaaacggcttctcattccaaactggttccggcggtgctgcgttggctgtcactcggtacttgcggcaagcaatgctcgataatcaaatcaaagcatcgtttgcacttggtggtattacgaagccaaccactgatttgctcgaagaagggttagttgacaaagtcatggatgttcaagactttgacaaaggggcggcagcatcgatgcatgccaatcctaatcaacaagaaattgacgcatcatggtacgctgaccctgataataaaggagcgatggttgatcaattggatgttgccattctgagtgcgttggaaattgatacgcacttcaatgtcaacgtcatgtccggttcggatggcgtgattcgtggcgccattggtggacatcaagacgcggctacggccaaactgaccattatctctgcaccacttgtccgtggtcggttagcgacgattgtgccagaagtaacaaccgttgtaacgccgggggactccattgacgttgttgtgacggaatacgggattgcaatcaacccgcggcgtcaagacctagttaaagcactcagtcatgtcccaggtgtgccggtctatacgattgaagaattacaacaattagccgaaaagaaagtcggccaaccccaaccacttgaatttacagatcgcaccgttgccttgattgaatatcgcgatggcacgattattgatacgattaaagcggtgaaggactaaagtatattgatgacaaaaatgacccggtttattactaactgggtcatttttatttatggtgaattgaaatgagttaagcagggcagttctattgcaagtgtgacaaaattttggttttataatgaaagtgagtcttaattagcgatgctatttgtcagccggtgtgtgtcctattccgacttccggggctgggtgacaattgctggaacgcagccgacgtcgatttgagctaacgcataacccgcgtcatctcaaatacgagtcttattctaagccggaagcagaccacttccagctaagaataatttggctactgagcattgtcacccagcccctccagtctcaggcacaagcttcagtggcaccaaacatgtttcggaaattcactcgaatggcagatgaacgactaccgaacttagtgcaatttatcgctgactattttgatactgggactttaaacgggacgttagggttacattaaccactttgttgagacgttcgattattattatggtgattccgaaatagtgagctatcacaatgtcgttttctgcctgacagttgattgacaaaataaccgtttataaaaagtagtgacgaattcaccaaaagttgggtacctcaccgtcagccattcgaataccatttcgactggaaggcgtttctgccaatgctcagcggtgaaattccacttagcaagcgtttctggcttggttagtggaagaccagtatttaagacgtgggttgcggcttaaatctgtgtccaccgcgttccagtaattggcagaaatgcctggaagtcggtgtaggacgaactggctaagcatatttaccctaattcgaattttttccagcgggtttaagctggtttgatctcgtttaatcatgactcgatattttgtgattgggaaaatttaagccgatgaagtaagcaaaaaatgacgattacgagtaaaattggtcaacagaaataaatcggaacatgtgaataaataaacatctttatcaaacacgcagttaccgcaaactttcagcgccaaacgactgttatatcaacctcataactaatgcttatagctaaaactgagtttgactatagctatatgggggcgctaaactaggtttataaactaaatgttatttttttcacacacttagtaagcgcttaccaacacattaattggaggttatcaacatgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggcctcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagatcggccggacccatcttcaagatgcaacgccattaacttttggccaagaagtgagtggttgggccagtgcgattgaacatgatattgcctacttaaaacagttgaatccaacgttaggcgagcttgcaatgggtgggaccgccgttgggactggtctaaatgctgcccctcattttgctgaaaatattgctgcggcgatgagcaaattgtatgggattgaatttacggctgattccaataagttctatggtttggcccatcattctggcttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgccttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagccatcaagtctggcaaagtaaccgcggaacaattcgatgaatggatggttccactggatatgacgaatattgatgattaagctaaaataagtattgatcggcgttgaaccgttaacgtggatcaaggtggcacgggtcattgttcctagacttggaatggtggcccgtgtccagttaacgacaataataaatgagattttggttccatcctggggaataccccggacgaattgagaggagaagtggcaatcaatggctgaaaagtttacatttacaccaaccgccttagcggatctaaaaccgaactatgacgtagtgattattggatcggggggcgcgggtttgactgcggcaatccaggcacatgaattgggcctgaacccggttattttagaaaaaatgccgaaaatcggtggtaacacaacccgggcttcatccggtatgaatgcggcggagacgaacgtccaattgcatcaccatattgttgatagttttggcgatttctacggcgaaacccttaaaggtggtggcggtatgaataaccaagcactgttgaaattcttcacggaacacagtgcgctcgcaattgactggttagcagaccacggcattaagttggatgatttgacgattactggtgggatgagtgtgatgcggacccatcggccaagttccatggctcccattggtggtttcttagtcactgagttgttgaaacaagtggcggctgaccagttaccactcttcacagatgtcaaagtcgatgaactagtcgtcgaagccggcaaaattagtggcgtcaaggcaacaaccccagatggagctgtcacgattacggctggagccgtcttgttagcaaccggtggcttcggtgcgaataagaccttgttaggccagtatcgtgatgatcttaaaaactatcagacgaccaatcagccgggcgcgactggagatgggattctgttggcacaagctattggggctaagttggttgatatggaccaagtccaagttcatccgacggtccaacaagatacagatcatgcttatttaatcggtgaagcggttcggggcgaaggtgcgattttggtcgataaccagggggctcgtttcgtcaatgaactcgacacgcgtaagaacgtgacggccgctatcgaccaactgggtggtactggtgcctacttgatctttgaccgcggtattcgtgaccgggtcaaagcggttgaattctatgatcacattggtctggtaaagactgggactgacttggaaacactggcgactgcgaccggcttagacgctgcgacgcttaaacagacggtggctgactggaatcaggcagtcgctaaccataatgatgcggcctttaaccggacgactgggatggatcgcgatattgcggcgggaccgttctactcaattcacattgcgccagctgttcactacacgatgggtgggattgccattaatccagcaacccaagtgttgaatcaggacgaacgaccgattgccggcctgtttgcagccggtgaagtggtcggcggtctccacggcaataaccggattggtggtaattcaatcgctgaaacggtaatctttggccgtcaagccggacaacaaatgttcaaatatttacaataagttattttgactaacccaaatcaatagtccatgcgcttgagtaatcggtgcgtgggctatttttgatttgggctgtagttagagaccaaagaaattagtttaaaaatcaactaatttcggttaagctggaaatataacaaatatataggaagaaagtgacaagcatggcgacgatttttacaaccggtgaaccgcaaacaatcacggcaatgctagcagcccgtgatcaacgggtcgcgtatcagcaacagttgacagcgactaacccccgggccacgattgcggcgatcaagttgaatattccgggaccgattaagaataacgctgcactacgacggttgtttttggccggtgtccagcggtttgaagctgagttgtcgacatacacggtggcagctgattggaatcatccggcgggtaatgagcggttcttgattctgacgactgactttgcgactagcaaacggctggcggtcgcgtttgaagaacacgatccgttaggtcgcttatatgatattgatatcttacaagcgggttcacagcgcgcgctgtcgcggacgtatttgggactgccgaagcgtcgttgcttattatgtcaccgcgaagccaaggattgcgcgcgttcacggcggcattcagtggctgagctacagcaaaagattgcggcgatgtacatgaaggaatttggtgagcgcggatgaatacacgtgatttagattattttcgggcgttagttgattgccaaaattatacgatggtcgccaagcagtttgcggtctcacaaccggcagtgactcaagcaattcatcggttggaaaaagagtttgcagtcaaattggtgattcaagaccgtcgccatcaacagacaaatattacccgggccggtcagctgctttacaagaatgcacgccagatccaggccagtttgcaacttgctcatcgcgaaattcagagtacgttacagactgatattcgttttggcttaccaccaattattggcactttatatttccctcaaattgcggaaaagttacttcagaacgggttactgcaacagttaaaaataacggaaacgggctcagatgagctattgcgtaagttagtgcatggtgagatcaacatcgcgttattagggtcctacttaccatttgatttgccgacagttcgtgcggttcacttaggggcacggccattcagtattatcgtgagtcctcaaaatagtttggcgaaacaagccgccgttagttttaagaatctcggtcaggcacagttcattggattggatggcaaatacgtgcacccacaagccttccgagcctattgtgactttgccggggtacatccagaagttatctaccggacccccgatatctcatgggtcaaagccttagttaaagccaacttgggcattagcttactggttcgtgatgtggttaaagcggatgatggcgtcgtatgtttggagatcaaagatcaattgccggtcagcttcaatatctcggtggtcacacgggccgggtacttaccaaccactgatgaacaacggtttattgatcaattacttaaaatgaagatttaaacgtcgcgactgagccatctgtctaagtgaacagcacgattccttgagtggttcaacttttactttgagattgacgtgtcttcacgattgtttcatttggatatattgcaatttgtaatgattacgaaaactgcaccaccctcacagactattctgtaagggtggtgcagttttgcttaatcggtctgatcagtgtcaaccgctaatgtttcgtgcaaaatggtcagtagctgttgctgcacgggggtcagaatatgggttgttcggtagacgatgcttgtgatgaattcagggggttcaatgtccatcaagtccagtcgtacgacgtcagtacggtagtgatcgacgattttggtgaagaaaccgatgccgacattttcaccaatcaatttcattaaaacgtgagtatcgttggaacgaaagacgatgttggggcgaaagtgattccggcgcgtgagtttgttgaaggccgtattatggatgaaattactattaaagaaaacaaatttttcacgtcgtagttcgttaaagtagacccgtttacgttgtgctaacggatgttgtttggacacgtagatacagaaggactgacggtcaaattcttcggcaatcaacgtttggtaagcgagcggctccaccgaaccaagcagggtcatgtcaacgcgaccgtcccgcacagcgttacgtagccagatcgagcccccctcaatggtttcgagaccggctaatagcccttccgcggccaatcgggcaccgatttttggaaaataatggttttcaataattggcggtaatcctaaaatcagtcgattttgggatagattgtcgatttcttggtgggcgaggcgtaactcatgtaaaacgattttagcgtgttcagcaagttgcgccccactagcagtgacgtgtaacgtatttttaacacggtcacgaatcacgagtggtgccccgaattcagactccaggcgtttgattgcggtggtcacagttggttggctcacaccgaatgttttcgcaacttttgaaaattttttttgaaaaattaattcatcgaaataagctaagtcttttgtgttcatttttattcctttctaaatcagcttttgtagcgaccttatttaatatatttatatcatatcatagttttgactataacattttactggcgttacagtattacttgtaaattgataggacgtttttcctagcaatgaaaattgatgaaaatgtaaattaattaggaggccgcagtaatgacaaaaactgcaagtgaaattttaaataacccattcttaaataaaggcactgcctttaccaaagaggaacgtcaagcacttggcttgacggggacgttaccaagcaaggttcaaacaattgatgaacaggcgacgcaagcttatgcccaattcaagagcaagcctagtcgtttggaacaacggattttcttaatgaatctctttaacgaaaaccggacactattcttccatttgatggatgaacacgtggttgaatttatgccaatcgtttatgatcccgtcgttgccgattccattgaacaatataatgaattgttcttggacccacaaaatgcggcctttgtttccgtagatgcacctgaagatattgaagcaactttgaagaatgcagcggacggccgtgatattcggttagtcgttgttacggatgctgaaggtattcttggtatgggtgactggggtgttaacggtgttgatattgccattggtaaattaatggtttacaccgccgctgccggcattgacccatcacaagtactgccagttagcatcgatgctggaacaaacaaccagaaattattagatgatccattgtatcttggtaaccggcacaagcgtgtttccggcgaacaatactatgatgtgatcgacaagttcgttgctgctgaacaacaattattcccagattcattgttacactttgaagatttcggtcgcgacaatgcgcaagtaatcttggacaagtacaaggatcaaatcgcaacctttaacgatgatatccaaggaaccgggatggttgttttagctggtatcttaggtgcattgaacatttcaaaggaaagcatcaaggaccaaaaaatcttatcatttggtgccggaacggccggtatgggaattgccaaccaaatcttggatgaattgatgcaagctggtttaacagaagaagaagctaagcaacacttctacgctgttgataagcaaggtttactatttgacgacacggaaggtttaaccccagcccaaaaagccttcacgcgcaaacggagtgaatttagcaacgctgacgaagtaaccaacttggaagccgttgttaaagccgttcacccaaccgttatgattgggacatcgactcagcctggtacctttactgaaagcatcatcaaggaaatggcggcgcacacggaacggccaatcatcttcccactttctaacccaaccaagttagcagaagctaaagcggaagatttaatcaaatggacggatggccgggccttagttgcgactgggattccagctgatgatgttgaatacaaaggtgtcacttaccaaatcggtcaaggaaacaacgccttgatgtaccctggtttaggatttggtttgattgcttcaacagccaaggtgctgaacgctgagaccttgtcagcagcctgccacgcattaggtggaatcgttgatacgtcgaagccgggtgccgcagtattgccaccagttgcgaaaattactgaattttcacaaaaattagctgaagtcgtggcacaaagtgttatcgatcagaagctcaacaaagaaccaattgcagatgctaaacaagcggttgctgatatgaagtgggtcccagaataccgggccatcagcaaatagtgtcggtaaaataagagaattgtaagagggtataagagcacatgggagttttatgggattcaattcaaagcgtcttagttgtcgttttgatcatgatattaggtttcgtcctacgacgagcaggttggtttgatgataagtttgctggaacaatttccaaatttatcaaaaatatcgctttgccagcatcgattttcgtatctgtgctgagccgactaactcgtgggcagttaggatcatttgcaggttacttggcttacgcctttctagccgtgattattggctacttgattgcctttgcgctagttaaggtgatgcgggtccgtccgggtcgtaaggggattttcatcaatgcgatcgtcaacgccaacacgattttcattgggttacctttgaacattgcgttgttcggtgacaagagtatgacgtatttccttgtttactatattgtgaacaccgtttcgacgtgggcattcggggtcttcttgatttcaaacgacgacccgacgaagtccaaggaaaagacgcataacaagatcgactggaagaaagttattccaatgccattggttggtttcttagttgcgttaattttcttactactaaatatcccaatcatgaaggtatcattcgttagttcaacgttgacttacgttgggaacttggtaacgccactttccttgatctacatcgggatcgtgttggccgacgctggtctgaagagtattcgctttgaccgtgatacggtcgttgcgttggttggccgtttcatcttgtcaccaatcgtcatgattcttgtcttgatggttgctggcaatctcggtgcaagtttcccaaccttagcatcgcaaaccttgatcgttcaatcagcaacgccaatgctagccgtgttaccaatcttggctaacgaagcacatggtgacgtggaatacgccactaacatcgtgacaacgagtaccgtgttgttcatcgtggttgtgccagtcttgatgaccttgatccaatatatttaaagtttatttagaagcattccggttgagagagacggaatgcttctttttttgatcaaaactgcttgagttgaacccgattaaaatatgttaaaggtcaaaattaaggtcgatcagtcgaattctttcagctgaccgaccttaattttttgcgaaaggagtgcttgaagatacaagcttgtggcgattacgtttaagcagatgaatatgatagaaacaaatttaagtcgggacgtatgactgtggactggtcagcccggttttcagcgacggttgacaaaatttggttaagtcgtgacccataataatgcggttaaattaaaattagtgaatcttatggattattaataaatttgtttaaaataactaatgctgtaaagcgctgtcttgaaaggattcaattaggaattgatcgaaattgttagatttacttgactaattgcacaaaaattaatagaattaacaacgttgcattattaagattttgattaggaggcgtaccggatgaaagcatcacaacgattgctggttaaaaaatcagtcaatccagctaattttaataagggtggcctcgaaaagacgttgagcgcatttagtttaaccatgatgggtgttggcgcaatcgtgggttctgggatttttatcacccccggaattatcgccgctaagtatgccggtccggctgccatgctctcatttgtgattgctgcggtcgtgtgttcgctggccgcattatgttacgctgaattttcttcaaccattcccttggcggggagtgcctatacttacgtttataccgtttttggggaattcttagcgtggattcttggttggtctctgatctcagaatatttattcgcggtatcctcggtggcggtaagttggtcatcgtactttcagaatttaatgagcggctttggcctaaaactaccaacatttctgaccgctgcagctggtactgccggtgtcagtggtgctggattcaacttaattgcttttgtcgtggttttggctgtctcactgttattggtcggtgggttacaagagtcaacacgggtcaattcaattatggtaatcgttaagattctagtgattgttcttttcattggcgtggcaattttctttgtgaaacctgccaattatcatccgttcatgccccatggtgttagcggactggtcaaaggcgcgtcgttagcattctacgcgtatattgggtttgatgcggtgtcgactgcttcagaagaagtgaaaaatcctaagcgtaatatgccaatcggaattgtcggttcgttagtcgtagcatcgattttatacgtggcaatggccgccgttctggtcggggtcgtgcattacagtaagcttaacgtgggtgatcccgtggcgtatgccttagccgtcattcatcaaaactgggcggcggggattgtgtcactgggtgccgttgtcggtatgacgaccgttttgattgtcatgttatatggtgggacccggttactgtttgcgattagccgggatgggttgttaccgaaagtctttcggacggtcagtccccataccaaagtgccagttaagagtacttggatttttggcattattgccagtgtatttgcggctgtgattccattagataaaattgcggagttagtcaatattggaacgctatttgcattcgctatggtgtctatcggtgttgtcttcctgcgtcgacacgaaacgctacaacaaatcaatagttcatttaaagtaccattttatccagtgttaccagttgtctcgttcctcgcatgtgtctacctgatgcttaatttgcaggcatttacgtggcatatgtttggtatttggctggttattggcatcgtgatttactttgcctatagttatcggcactcccgtattcgagcagggttacgtgccaaagaatcaaaatcgtaattaatagtgggtgcttaccggggcgggtaagcacccattcttttcgcggctactaagctttgggatatgctataattaagcgcataattcataaggtaaagagagttgaggtggctgatgatgcagagacgttcaaacgcctatcatatcagtgtattagcggtactaatggcaatcgtgatcattcagaatattgttccgttttttgggtacattccattaccaggattgagtattacgacaattcacgtgacggttatcctggccgccgtggtcttgggaccgcgtgatggggcaattattgggggcgcatggggaattattgcgtggatacgggcgttcgtcgcaccgacgagtcccttagcaccaatcgtatttaccaatccattgatttcggtgataccccggattctcgtcggtttgatagccggttgggtctttatttggtttcagaagcggcatcaaaaagtgttggggatgacgctggcgggcgtggccggggcattaacgaacacgattctagtcttaggtttgattgggctactctatagtcatcaagcagccggcttttatcaagttaatttgagcaaactaatgccgtacttgttaacgatcgtggcctcgaatgggattccggaagcgattttagctggaattctcacaccactgattgggacaccattactacgttttaaaaaataagtcgctaaagtgacagctagcttgaatcaattcaaatttaaaacagccacccttgaaatctcctgaatttcaagggtggctgttttaaatcgctatttaacggcttgaacttgtttctgactaataattactttgttgtgatacttatcaacgatggctggatcaggacttgtaaaggtgattaaatacgaattagtgtaacttttcgcaatggtcccggtataagtctggccttccaaaatgaacgtcacttgtgttccaatatccatgatgatgcctcttttcgcacgatagttttattaaggataacacaccagtggacgtaacaggtaaaagttcactaattaaaacgtcgccgaacttgggcccaaatccccgttgctagggctaagagactggtacccagcgttgcgagccatgactgagttgtttcgtcggtctgcgggagctcagttgtggctttggatgctggtgaggagacggcaactaagtcggcactgtcagtattagttgttgtggcagataccgtggctggcgtcgtcacacttgcttcctggtcactataatcttgaagcagactagccgtgacggccgaaccgctgtcatcgtgattaactaaccagtcagtgttagtcgtggcggttgaaccgaccataattgaatcactgacttggcccttaatcacgatgctctgatcgatagtgcttgtctggttcacagtggtcgtcgcacgtgttgcgtcaaccgccgtgtcggaatcactatccactgcgttatccgtgtcgttcaagtcaacgtaactagtcgttgaatcatcattaggtttcgcatgattggtcgtgtccggtgttgtatcactagttatgtcggtagtgtcagtggtcgtgttatccacgatagtttgatggtcactgatggcctcatcagccgtcgtttcatcggtaacattgtcctgtgctgtggaatcggtcgttgtaccgttgtcagccgctccctgattacgattatccgttacttgatcaacatcaactgcttcatcttcagcatccgctacggatagcaatggtgttaagaaagctaacaagtgttggcggtattgtaggatcgcgttattagccgcagcgtgaccaccgacagtccctggtaagatccaaacttcttggttggcagaatgattggcggccgctaattccaatgattgagtatatggaatgaaggcgtcgtcttgcgtgtggatcaagagtaacgggatagtgattttgctagctgcatcggttgctgataagtcatcgacactgaaaccttgttccttgatcaaacgagcgttcatcgcggccacgattttatcataggataagaagggcaggctcgtgatggctggcagaccaacggatttaagtgcgtttgaaacggcggtgatggctttgttgtatagcgaactacctagttctggtaaggtcgcgtacccggcgtccgacacaactgctttaacggattttgaaagtccaggaactgaggctgcttctaacacggtgtcggcacctaatgattgaccataaaagacgacttgactgtcggcaccattgcgttcgtcgaccatcttaacccaattcagccagtcatacttgtcctgataaccaaacgttaagttatcaccgtcacttaggaattggccacgttgactcggcatgaggacgttataacccatgtcataccaaatctttgaaacgtagccgatccaatcaacatgttccgtccaaccttggccgatgatgacggtcttggtggaatcaccgttttgaatatagtaagcacggacagactgcgtcgggtcattgtattcaggcagggtccaggtttctttggtaacgttatcccaccaagtaactgttgtcggataatactcttcggccgcagcccggtcagcagcataagcgactggatcgaggccggtccacgtattggagatgtcatagcggtgctggttcatttcagtacgtagattagagagggcttctgagccagttcccgtgaagacgattgggtagagtacattacccacgatcgtgctggcgatatctgtggggagttctttcaactcgtcaagaattgtcatcagtttggctttggctgctgctaattgttcttggccagacggggtcgctgcttgatttgctaagtccttgatcgtattaacgacggccacaatatcactggcatctaacgttaccgtggtggtgtccgtcttatcagaggtagtaacttttttccaggtcacactgtaagggccactttgtgtaatggtgaccgtactcttttgattgccagtcgtgtcgttggtttcgtagattaagccatgaccgctgtcacttgtcgcggcactagccgcgctggtcgtcgccacactagttggcgttgccgcagcggtcgaattggtgttggtactcgtatcatcagttgaatcaatagctgaatcggtcgttgattttgtcgtggctgtcgccatatccgtgacttgagtagcgtcactcgtcgctgagctagcggcctgttcgttaccacttatggtattggctgccgtcgaattagtagcgctggtcgtctgactagttactgtgccactcgcactgttaacaacctcactagcttggtcggtagctgacgctgcacttgtggcttgttcagtcgcgctagtctcagtagcgttagtactagtcgtaatttgattggtgtcagtggtagcgctgctgtcggtatttgacgtggtattactgtcttcaccagtagtcatgctacttgtcgtggttgactcggttgccgttgccccggcggcttggctgagttgactggcaacgctagctggggcgttggccgcagaagtggtcgtggcactaacgggggtagccgttgctgctaaggcgttagtcgtcagcattaacgtactaccgagccccgcaatggtaatccccgcgtaaacccaatgtttgccatctttgaacattttataatgatcaacggtggttgattgttgtgaattccttttcattatatttactcctcgtaacgttttattctattgcacgttttaaaatatagcacgacaacccaggcttgtttgcgttttcgcgggctaaacttgttaaatgaggtacttttttaataacggcatcagttgtttattgtatgaactaatttgttaactgattgagtacgatgattgatttttatgatgcgacaagctcagttattcgcgggagtcacgcgtgattttaccagcagatgccagattgcaaaatgtgaacttacaaacgaataagcgtactaatagtggccttgaaaattagcggctttgactattttgggaataaaagttgagattgattgaaatttcacttatcacttgctattatgaaaggtgaataaagtgtttccgctttcgtagggaataaattaataaaggggggaccattatgaatctcggattaagtattttatccttggcgcgctttcagttcgcgatgaccacggtgtttcatttcttctttgtgccattatcaatcggcttagccttggttgttgccattatggaaacggtgtatgttgtcaaaaaagacatcatgtacaagcacatggcacaattttggggccgcattttcttacttagctttgccgttggtgtcgtgacagggattatacaagaattccaatttgggatgaactggtctgattattcacggtttatgggtgacatttttggggcgccactagcgattgaagcgttagttgccttctttatggaatccacgtttattgggttatggatgtttggttgggatcggtttaatgccaagctccactgtgcgtttatctggctaacgtcgattgggacgatgatttccgcgatgtggattttagcagcgaacagtttcatgcaaaatccagttggttttatgatcaataccaagactggtcgtgcacagatgacgagctttgcagcagtcgtcaagaacgaacagctctggtatgaattaccacatgtgttgtttggggcgtttgttaccggctcatttgtggttgctgggatggcggcgtttgcgttactcaaaaagaaaaacgtcacgttcttccgcaaatcgatcaaggtcagtttaatcgttggcctggttgcttccatcggtgtgattggaatgggagatttacagacgcgttacatcattaaagaacaaccgatgaagtttgccgcaacggaaggcttatataaggattccggctcgccagcttcatgggcagttattgaagggatggatactaagaaccataaggccaactggtcgattgaaatcccgtatgtgctggatattttaagctatcataagttgtccggtaacgtgaagggacaaaatacccttaacaaggaacttcatgccaagtatgacaagaaatttggtaaggacatgaactactacgtgccaacaaagacgctcttctggagcttccgggtcatgacggtagctggtgggctcttcgcactgattgccattatcggtctgtacttcaaccgtgcaaagtcaacgttgattgagcggcagcgctggttcctgtgggtactaggaatctgtacgttcttaccattcgccgcaaacacggccggatggctgattactgaattaggtcgttatccatgggttgtttatggtttactgacgattgcggatgccgtttcaccaaatgttagtgtcgcttctttgctgatctctaacatcgtgtacttctgcttgttcagtggcttaggcattgtcatgatcgtcttatcacggcgtgccttacaccaaggacctgatgatttgttacaagctagcgatgacgcaccgtacgatccttatggtaaggaggcgttcagtcatgagtaatctacaattcttatggtttattctggtgggcgttctatttagtggtttcttcttccttgaaggttttgacttcggggttgggatgacgattaagagcttagcccaaacacgcgctgagcgcgatgttgtgattcatacgattggcccacattgggatgccaatgaagtgtggttgatcactgctggtggggcgatgtttgcgtcgttcccaatgtggtatgcttccttattctccggattctatcttatcttattgttgattctagtggccctcattatgcgaggggtctcatttgaatttagaagccggatggaaagtgacgccggccggaatttctgggaatgggccgcagccctaggtagtttctttgctgccttcctatttgggatgatgtttactgctttggtcaaagggatgccaatcaatgccaatggcgatatgactgcccacttcaccgattacgtgaacttgttctcaatcgttggtggggttgccgtaacgttactctgctatttgcacgggttaaactttattcgtctgaagacgaccgggacgttgcgtgaacgggcgcttcagtgggccaaaccgttatactgggtcctgtttgccggtgaagttgtcttcgcaattctgctgttctttaacaccgatttctttaccaagaaaccaatctcaaccacgattttagtggtcgccttagtggctttgacggtcttggcaacttggggtgtttatggaaatcatgaatggctctcatttattagcagtggtctctcactgatcgacgtggtcgtgctcctgttcaatggactattcccacgtgtcatggtggcgaacaattctgcatacagcattctgattaaagatgcgtctaattcaccatatacgttgcatctgatgactgtaatctcattatcggtattaccgattatgttgatctactttatttggagttactgggtcttctataaacggttggcatcgtaattcaaatgcagatgacgacagtatcactggtgcggtggtacaattaatttaacagcaccaacggggtcgcgaccttggccaagtgccagggtgcgaccccgttcattttaagtagggagtgatcgaatgtgtttgatccggcattatttaaactaccagggatgcgccgagcagccacgattttagggttactggccatcgtcgagggtatttgtattgtctttcaggcctactatctatcagtggcgattgttggactgtggcacttgcattcattggcgtcgatcagtcagcccatgctatggttcgcattagcttgggtcggacggcagttactggtcgtcattaaaaatcgtgtgatgtatccgttagtcgaacagacgacgggtgacctgcggcgtaaagtgatgcagaagttataccggctcggcccaagttatgtggctaagactgggactggtaacgtggtgacgacagcgcttgaaggcatcgataaagttcagacatacttaatgttggttgtgattaaagtaatcgacatgatggtgatcccgtggatcattttaatttacatcgcgtggttgcgttggcgtgaggccctttttctactggcaatttttccattaattattctatttatgattattttgggctatgccgctcaagctaaagcggataagcagtacgtgggctatcaacggatgtctaatcacttcgttgatacactgcgcggtttaccgaccttgaagcagttaggactgagcaaacggtacgctgacaacgtttatcaggttagtgaaggttatcgtaagcaaacgatggcggtcatcaagattgcgatgttatcgactttcgccttggatttcttcacgaccttatcgattgcggttgtcgcggtcttccttggttttggtttgattaacggcacgattacgttgctaccagcgttggttattttggtcttatcgccagactatttcttgccattacgaacatttgctaatgattatcatgccactttaaatggcaagaatgcgtttgcggatgtccagaagatgctagctttgccggtgccaactgaacgtcaacagctcggtactcagcctgtgcaatggcaaagtgatagtacgttaagcttacatgacgttgattttaagtatgatgatgatcagctggccttaaaacacattaatattgatgtgcatggttaccaacggatcgggattattggggcatccggctccggcaaatcaactttgatcaatttgttaggtggctttctaaccccggtcgctgatcagggtaaaattcaagtcaacgggcaaacagtctcgtatttgagccaggacgcctggcagcagagctttttctacattccgcaaaacccatatctgttccatgcaacgttagcagagaacatcgctttttatcagccagacgcttcacgtcaagcgattgaacgagctgctgaaaacgctggattaacggcctggattgcaacgttaccagcggggttggatacggcgattggtgaaggctcccgtggtgtcagtggtggtcaggcgcaacggattgctttggcgcgggcctttcttgacgactcgcggcgagttctgttatttgatgaaccaactgcccacttggatattgaaactgaagcggaactgaaaacgacgattttacccgtacttgataatcacttagttttctttgcgactcaccggttacactggattaatcagatggattacgtgttagtgatggatcatggggaaatcgttgaacaagggacaccgacggaattggccgcgcatgacggggcgtacgttcggttacgtgatgaaatggtaggtgcgatctaatgaaagattttttggcaacttttaaaaatgatacttgggtcatgccgtatttgcgcaagtataaaaagttactagccctgacgctgtttttgggcctaatgacatttttctgcggttcagcgctgatgttcaactcgggctacttgatcagtaaagccgcacgacatccgtataatattctgatgatttatgtgccaatcgttctaacgagagcgtttgggattggtcggcctacctttcgctatgcggagcgaattacgagtcataactgggtgctacggatcgtgtcagattttcgtaagaaactgtaccaatccgtcgccaagcacgccgtagcgattcgccaaaatttccagactggtgatgtcctgagcattttagctgacgatattgaccatattgaaaatttatatttacggaccgtttttccaacggtgattgcctggttgatgacgctagtgattgtgattggtctgggctactttagctggtggttcgggctattgatgttgttgatgttaggattggtcgttgtggtaatgccgctatggtcggtcttactgaatggtgctcgtgaatcacgcagtcgtcagattcaacagggcttttatacgcagctgactgattcggtaatggggctcggtgattggttgattgccggacgtcaaacggatttctatgagcggcaaacccagcctatcgaagcaattgcggcacttcgtaaacaggaccatcgctttcagtggtggcgagattttacgattcagatcattttcggggtgatttgtttggcgctcttgatctggagtagtttttactggacaacgaatgcggctagttccaattggattgcggcgtttgtcctctccgtattcccgttggtcgatgccatgcagtctgttagtcagggtgttagtgagtggccaagttatcaacggtcaatcaaacgagtcaacgccttagacaccacgcctgaagatgaacacgatcagacagtcttaacggagccatttcaagtattgcgtattgcggaccttgactttaaatatgcggaaggtggtcacgcgatttttgacggtttgaatctgactttaaaagccggtgaaaagttagccctgctaggaccttccggaacgggaaagagtaccttgctcaagctgattttaggtgacctgacaccggatagtgggacggttcaattgaatgatgtgcccatcacacggttacaaaatgagcgcgcccagttattcggcgtcttggatcagcagccgtacttgttcaataccacgattatgaacaatgtgcggatgggtaacttgcaagcgactgacgaacaagttaaagccgcactagcagcagtcgagttagcgcccttgatcgacacgctccccgatggttacgagacagttgtagaagagggcggtgcgcgcttttctggtggcgaacgacaacggctcgcgctagcccgcatcttattacaagatgcgcccatcatcattttagatgaaccgacagttagtcttgatccgattaccgaggcccatttgctgaccacggtgttccgggtcttgcatgataagacgattctgtgggtcacgcaccatttggccggggtcaaccatgtcgaccaagttcgcttcttggaagatggtcaattcgatatggccggtacgccgagcgaattgtatgcgaacgcaccgcggtttaaacgcctttatgatttggatcaagggcgtgatgatgcgaacaatgatcggtaatccggttgatagcagtcttcacgtgcaccttgggcttgtgaaacagacttttaattactgcgctgaatgggtattcagcctacgaatgtagtggtcatgatgaccattactgattacaccgccgatttagagcgtaaaaaggacttggtcgctgtgaccaagtcctttttatatgcaattaatcgccaggttatgatttaacctgttagtaattttgtaattgtgcccgattctgaacgtcgaccacgtaggctttcgtgcctaagcggctgagtaaggtccgtacatcattgtaattgattgagacgcaaccagccgttgcccattgattcttgacgtgaataaagaagcccgagccattatgctgaccgtgattgtccatcacaatcgctaattgatactgattgtggggcgcggccttcgtgtaatcgatcagatgctcgttcttattattggcccagtttcggttctgccaagtgttatattgccggtcatgtggatcttcaatccagtaagatttctggttgatctgtcgataggccataccactagttcttgcactggcagctttaccaaatgcgaagcttaagtgataaacgcctttgggtgtggtactgctgccttcgtgagaattgccgatgccagcggccccgatgcgacttgcggaagttagtgtattcttccagccgcgattggttttttgccaaagtttaagagtggccgtggatgagccattttgaatgaccgtcacgatttgctgagcctttttggacacgcgcattctggagacgagtgttgcttcggatggggtggcagctttggctttaactggctttaagtagccactccaaatccagccagtggccccattcttgctattgtgaacccagtagtaacgaacctttttgccgtgcatgataatatcagtttgctgagtcgttgtccagacggtgttgcgatagttcttcaaatcatgattggccctgaatgtccaacgattataattaccattagccctaaaggtatgtgatttggtatcggtcgtataataggcctttctagccgttgcccgcgttggcgtgcgatgatagtaagtgctggcattcgcagatactgaacttagcattgtgaccgctgcgatcattagtacgctccccagcaaccaattaacaatctttttcatgaaacccctcctagtaaaaatagccccgttattacaatttttatacaaacactataatactatttatctcggcggaatggataacaattttgactaaatcgcggcggtgtagggtgagtaatggttgtagctgaaaaatcagcgcgtcagagtaataggttactttgacgcgctgatttaatttgtgtattaatggttgcgaaccagtaattcagtcactagccggcgtaaagtttgttgtgtttcaccagttggtagctgatcgattaggttcagtgcggttttggtatagtgagtagccaattgttgtgcctgggtaacgccccccaaagcaatgacctgatcgcgaattgtcagtagctgttcattactgatgtggtcgccgggttggggtaattgttcggccaattgtggttcagcggtcagggcgtagataagtggcagtgaataaacgccgtcccgtaagtcattaagcaccggcttttgagttaaggcctcatcaccggcgtagtcaaggacgtcatctaacatctggtaggctaaccccatcctttcaccaatctgttgcgctagtttaacgacgcttgcgtcggcacccgcgaagtgggcaccttgttcacaactgaggctgaacagacgggccgttttgccacgagcaattgctaagtagtcatcgaccgtggtcgtcggatcgaagttatgtgccatttgatccagttcgccttggaggatggctcgcatcgccgcagtattgattttaacgtcgtcagctgtcttggcagcaatcaggacttgatcgaaatagcaggtaaacaacagatcaccggcgtaaatagcattacgttgaccgtagtcttggtggatcgttgtcacatggcggcgttctggcgattcatcaattacatcatcgtgaatcagtgttgccacgtgtagtagttccatagccgctgcgccagcacgtaaccgggccgtgttatgatccggtccaaattgactaaacaagtaaaagaagcccgggcgtaaaaacttaccacccgcagcgagtaagtcgtgtacgcggtcattaatggcggcgttatcaatttttacgttagtagctagatacggcttcagcgctgctagctcctttgcgacaagactttccggttgccaaatggtttgcatcataatcaaaataccccgctttatttgagagatggctccgggacgttttgacgccaacacttgcagccagtcacattctaaaatacaatctatattaaaggtacaaataacttgtttcgttgtcaaacaaaaggatggtgtaaatcattgaaaccaaaagtgtttcttgaatttgttgaaattaaatcattaattgcgagcgtgttaccgttcgttttggggagtatgtacgcctattataattatcatcagttacatcttggttatttattgctatttttcattgcatcttcactttttcatatggcgactaatgcgaatgataattaccaagacttcctacacgcgccacgtaatgacgacaatcaagaatttttgcaagagactaatgtggtcggtgttaaccagatttccattggtcaggcccggacgattacgtttggtttagccggtatctcattgattatcggactatggttagtaacacaaaccgggttgccgttgttgtggatggggctatattcatatgcggtcggttacttttacgctggcggtccgaagccaatttcacaaggcccgtttggcgaatttttctcgggctttacgatgggctttatgatcttctggattgccgtctttattaatacgtatgacacggcagccattacttggcagtcaacgctggctgttttaattgcgtcaggtctggccatttttgcaatttctaacattatgttagctaataatatttgtgatatggacgaggacattgcgttaggccgacacacgattttgtattatcttggcaaaccggtgatgcttcaggtatttgcatggagttacgttgctggttatgcttgtctggtgatcgcggtcttgatgggtgtgctgccaaagtttagtttactaacgttgctcagtattattccagtttggaaaaatacgcgggtcttcttgcacaaacaggtcaaacgagaaactttcacgatttcaattaaaaacgcaacgttgatttgtctttcatttatcgttttcatgggcttaggactgatttttaactagtccttcaattaaacgagtatggctttgagaaagcgccaactaaccaagttgatactaagcagtatttttcccagcgagtccaagctggctttctgattttatggcttagggtttttcaatggtatttcacgggggtaaaaaaagcttagatatcgtgtgaaaaaacacacggtatctaagcttttttaatttacataaagatgttattcataactagttttcaaatggatagcggaagtcccattgtgcacgagcggcagtcatgatatccataacgtcagtcgttttagcaagactcgtgttgtgtaattcgccagcaaccattttttgcatgtcagcaatttcgtaattcatggcgttagtgctatcgccggctgtgatggtttcagtatggccttcgctgtcggtgaaagtggcactgtcggcacgtggataggtatcaacggtaaagtaaccattctcatacgcgacgataccgcgtttaggcattttagctcggaacgttaaggcaacggtggccagttcatcattggcgtttcgtaacgtgattgtcgaagattcatcgacgccactgctgaatcggtgcatggttgttccggtaatgtatggtttagcagtcaagaattcttccatgaaggctagggcatagacaccaatgtccagtaaagcaccgccggcaaggtcgggattaaagaagcgattagttgggtctggttctttaaaactaccaaagctagcttggatcattttcagatcaccaagatgacgttctgccgcaaaatcatggagcttctcgtataatggcatgtgatacagggtcatcgcttccgctaagataaggtggttgctagcagccacttccttggcgattgcgagttgggtactagacattgtgatggccttttcactgaggacgtgtttgccagcacgtaaggcgggtaaaatcgtgtcaatgtgataattatggggcgttgccacgtaaacgatgtcgacttgttcatcagccagtagctcgtctaaattaccataagctttgggaatgttgtgttcggcagcaaaggcgttagctttttcctgcgaacgtgagcaaacggcgtagatttctccgtcaggttgatcaaaatatttaacgaaactgtgcgcgatgttaccaaggccaacaatggcccagcgataagttttcgacattataggttcctcctaggattaatcgaatgtgaccacttacattttagcaaaaaaataaggaattggcgcccaataatcatgtaaaattaattcaaaagtcggtaaaatagagtgtaatatgaccgatgctcattgcgatttaggcttacttagaattaaaacatgttggttagttggattcttattcgtcagcacgtgcgcgtcttatgccgactttcggggccgggtgacaattactggaacgcagccgatgtcgatttgagctaacgcccaacccgcgtcatctcaaatacgagtcttaatctaaacacgtttacactaactcgcactttttacagttggcctaagctggcagcttttgaactaagaaaccagcatgttttaatcctaattcatgataaatgaacaggtgtaatctgtaaggtaattaccagaaaggaggcggctatgatggcgggtaagcggcgaaaatcgcgccggaagcaacggacaaagacacaattatttgtgaagaagggccgccttcagtgggtcaatatcttattagtgttggaggcgatggtggggatggtttggtatattcagcataattgggcggttaagtcgcgggttacggcgacagcacctacaacaacgcatgcggcatttattaaaaagctagtaccagctgcgcaacagcttgatcagcaataccacgtgctggctagtatcacgctaagtcaggcgattttggaatcggattggggacaaagtaccaatgcgacagagaataataatttatttggggttaagtccacgtcgggacggctcatgacgacgcaggagtattatgacggggcctatcatacggtcaaacggcgcttcgccgtttatgatagctggcacgcttcgctggtcgatcatgccaagaaattggcgtacggaacgacttgggattctcagcactacgctgcggtgattaaggcaactgattatcagacagctgcgcaagcattgcagacggctggatatgcgactgatccaagttatgcacaaaaattaattaatattattcaaaaatatgacttacaacggtatgatagaaagtaatgaaattaatagcagtatttcaatgtcgcttataattctaggagggtactatgcgagaacttgaagaacgcattttgaaagatggccgggtacttcccggtgaagtattgaaagtggacggctttttgaatcaccaagttgatcccgacctgatgtttgccatgggaacggaatttgcccacttgtttcaagatgcgggtgtaacgaaaatcttgacggttgaatcatcaggaattgcgccggcagtcatggcggggttagcaatgcacgtgcccgttgtgttcgcacgtaagcacaaatcagtcacgttaattgatgatttatatacagccgaagtttattcttacacgaagaagacgtctaaccacatctcgattgccaagaagttcttacaggcggatgaccaagtcttgttaattgacgactttttggccaatggtcaggcggttcaagggatgtttgaaatctgtgataaagcgcacgtaaaaattgcgggtgtcggtattgtgattgaaaaagtcttccaaacgggtcatcaactgattgctgatcggggtgtccgtttagaatcactagcacagattacgtcatttgatggtgaccgggtgcactttgcatcggaggacacccaggcttaagttaagaaagcgggggattgtgatgcacattgacatggggatgctagtccttattttcatcatcaactttgcttacattacgttaaacaccgtacgttttttgcttgtaatgcggggttatcggtattttgcagcttttgcaagtgtcattgagattacgatttatgtgctaggattatcattggtcttaagtcgtctcaataatccgattaatttagtcgtatacgcgttaggttacggtgtcggggtgtatgttgggatggtaattgaagatcgattagcgttagggtatacaatgatttcagtcattttacctgatcccaagtcgtcgttaccgggagtgctccgtgaaaatggctttggggtcacacaacacgctgcttatggtctagaaggtgagcggctagaactagaaattttggccccacggaagaacgaacggcggctgtatggcctgattaaagacgcggcgcccaatgcgtttgtgatcgcgtatgaaccacgctacatctccggtggcttttggctcaagcgagttaagcgacgcaatgctcgccgaaaaaagcagtgataaacttgcaactgtgcgtgtcagcaagtatgattgttacaggataatgagcgttaaaataattcaataatcagattataattatttaaagcataggaaagtagggactgaagtggacaactcgattttaaacccaggtggtacgcttggcattattggaagtagtactaatggtgttggattagtaattgccgcgcgtaatgctggcatcaatgtcggggtatacggcgataacgaaaatactgagaccatggaactggcagattttcgcgttgtcggggccctcaatgatcaacaacagttacagaacttcgcagaacgttgtgatatggtgacttatgagtcggaaaccattgatgcgtcggtcattaattttttggcggcccatacccgggttccacaaggcgccgatgcgcttgagattacacaggaccgctctttggaacgggcgtttttcagccaacttaacttgaatgtagcaccgtcagcgacaattgtcagtttggatgatgtctatcaatcgatcgggtcaattggatatcctagtattttgaagccgattcaaaagggcttgggtcaaaatcggcaactggtcattaagacgcagacggatattgtcaaggcggctgatctgttggattggggcacatacttgttagagtcattgattccatatgataaggaactctccgtttttggcgctaagagtggtgatacgacagctttcttcccaaccgttgaaaaccggtatcgtaatcatgagctagttgcctcgattgtgccagctcaaattgattcagctgtgaatgacgaaatgctgcggatcacaaaggaaattagtgataacttgagttatacgggtgtctttgaagttgctttcttcttaacgaagagtggtaatttatacgtgaagcggattgtccctgcgatgcatcaggcgggttatgtcttcgaacgtgctacgaatattagtatggcagaacaacacttgcgagcaattgcgggactgccgttaatgccagtcaagcagttgatgcccgtggttgctgcttactttacaccggctcaggagagtggcattcgcacgcagtggcagattaagacgaactggttctttaatttctatcaccgaacgttgttacaagcgcaccgggcaccagtcgctggccacgtgctagtcgaagcaccaagtgttaaagaagcactcgaacagatcgaagacacaagtatttggcagtttgggcaaacgacgccggctgataatgaacctgaagctgagtagtgtatgatcagaacctagttttacggattgttacggttaaactaatcgtactgttcgcactgggtgaccagctattatgggtaaccgtcgtgaataaataaagttcgaaatccaattcattttgtgaattggatttttttagcggtttgggagaagccagccaaatggcgagatacggttatctgagggggaatcgttgagattggcgtggcgggtattttggttataaattgagggagtctcaaaattacttaaagttacacaatattgccgtcaattcgtttcccgtgaatagtagaagttgtaaaattaacataggtgtcactgacaatggaaaaaccgcgatttttgtatgagatgctgaccttaaagtacagcaatcacggccaaaatttgctataatgtttggtgactgatttttagaaagggtggcgaacagcgtgtcgaaagaaagcctattggcaggaatgaatgacaagcagcaagaagccgttttagacacagaaggaccgctactaattatggccggtgcgggctcggggaagacccgtgtattgacgcaccgggtagcttatttaattgaagagcaaggggtcaacccctggaatgttttagcgattacgtttacgaacaaggccgcacgcgaaatgcgtgaacgggttggtaagctgttaggtgaatcagcgcaggaggtctgggtctcaacgttccatgccctgtgtgtccgaattttacgacgtgatattgaacaaatcgggtataaccgagcgttcacaatcgccggcactagcgagcaacggaccttagtcaaacgaatcttgacggaacaaaatatcgattcgaaaaaatttgatccacggtcaatcttatccgcaatttcaaatgcgaaaaatgacttacaaacgccggagatgtataaagaatcggctgccagtccctttgagagtgtcgtggcagacgtttatttgcaataccaacgtgaattagcggctgatcaagccgttgactttgatgatttgatcatgctgacgattcaattattcaagcagaatccagaaacgctggcgtggtaccaaaacaaattccattatattcacgtggatgaatatcaagatactaataatgcacagtatacgttagtcaacttgttagctgacaaatataaaaatttatgtgtagttggggatgcggatcaatctatctatggttggcggggggccaacatggaaaatattctcgatttcgaaaaggattatccgcaagctgacacggtgatgttggagcaaaactatcgttcgaccaagacaattttgtcggcggctaatgcagttattaacaataattcaacgcggcggccgaagaaattatggactgagaatgaaccgggtgacaagatttcttattatcgtggtcagagtgaaagtgatgaaactcactttgtcattgccaagattcaagaaagcatgcagcagaacaaaatggactacggcgattttgcgatcctttatcggacgaacgcacaatcccgggtaatggaagagtcactcgttaaggcgaacatcccttatacaatggtcggtggtaataagttctatgaccgtaaagaaattcgggacgtcttatcctacttgactttggcagtgaacgatcaagattcaatgaactttgaacgggtcgttaatgaacctaagcgcggcattggtcaaacgagtgttgaaaaattgcggttgttcgcggatgaagcgggttattccatgttggaagcagctagcaatgttgacatggctaatggcatttcagcacgagcgaagggtgctttagcgaagtttgcagcgacgatgaatgaattgcgcgctatgcgggaatacttatccgtgacggatttaacacaagagattcttgaccgcacgggttacatgaaggcgttgaaagatgctaaggcaacgaaatcgttagaggcacaagcccgtatcgaaaacattgaagaattcttgtctgtcaccaaacaattcgatgatagttatcaacctgaagatgaagatagtgacaaattcgtggacttcttagcggatttagcactggtttcggatgtggataacgttgaggaagaaccccaagccgtgacgctgatgacgttacatgcagcgaaggggctagaatttccggttgttttcttgattgggatggaagaaggtatcttcccactgtcccgggcaatgatggatgaagacgagctggaagaagaacggcggttagcatacgttgggattacgcgggctgagaagaagctgtacttgaccaatgcatactcacggatgctttacggtcggcggcagaataatccgacttcccgtttcgttgaagaaatcgaaccagaattactcaaaaatgaaaatacgttggatggtgcaagtagcactggtcctaaagttccatttggtgcggatcgtgaacggcgtgcttttacaccttcatataaaaagaatccagtggggacgcgggccacggtcaagaaggctagtggcacgggtgctgacaagaatagttggtcgatcggtgataaagtcaagcatcgtaagtggggaaccggaacggtcgtgaaggtctccggtgctggtgaagatgctgaactagacattgctttcaaatctgaaggaatcaagcggttattagccgcatttgcaccgattcaaaaagtacaggactagttaggaggactggctgatggcggacaaacccaacacaatgacggttgagcaggcggctgatgaagcggctgctttacggcaaacgttaaatgaatggcgtcggcagtactatgacgaagatgcgccgaacgttgaagatagtgtgtatgatcaaaagtatgaacggttggtcgaactcgaacaaacttttccacagctcgttacaccggattcaccaacgcaattagttggtggaacggttaaagcaggctttgataaagtgacccatgagattccgatgttgtcattgggcgacgtcttttcacaagctgagttacaagagtttgttgatcgcttggaacaaaacgttggtcatccagtcgattataattgtgagttgaaaattgatggtttagcgctgtcgttacgttacgaagatggggtgctcgttcaagggtccacgcggggtaacggtacggttggcgaagatattacggctaatattaagacaatcaagtcgattccacaacggttgacccgaccactgacgatcgatgtacgtggggaatgttatatgcctaaggcagcgtttgctgccttgaatgaacgccgagaagcagcgggagaaccagtctttgcgaatccacgcaatgccgcggccggtacgttacggcagctagattcacgagtcgtggcggaacggcagctcagcacgtttatgtataacattgccgactacgaaccgttaaccgcccgtacgcagagtgacatgttaacggagttcgcagatcttggttttgccatcaatcctgactttaaggtggcccattcgatggccgatgtctttagttacattgaccattatcaaaatgaacggccagaattagcatatggcattgatggcatcgtgatcaaagctaacccgttaccgctgcaacgctcactaggagcgacagtcaaggtgccacgatgggcgattgcctttaagtttccacctgatgagcagccgacccttttaaaggatgttgaatggactgttggccgtacaggagtcgttacgccaactgcggttatggaacccgttcaactagctgggacgacggttgcgcgggcttcgttacacaatcccgattatgtggcggccaaagatgtccgcatcggtgatacggtcttgctacacaaggctggcgatattattccggaaatttcatcggttgatttagccaaacgactcaaggatgcgcaaccattagttattccaaccacgtgtccgtcttgtggggcgccgctggttcatttggaagacgaagtggctttacggtgtattaacccgaaatgtccagcacaagtccaagaagggctggttcattttgcctctcgcaatgccatgaatatcgatggcttgggaccacgaatcattgcgcaactctatgcaaatcggctggttagtgacgttgccgatttgtaccgattaaccaaggcacaactgttaacattagataaaataaaagataaatctgctgaaaagctcttgacagcaattgaccgtagccgtgataattcacttgaacggttattgttcggtcttggtattcggcacgttggtgctaaagtggcgcggttaatcgcgcagcattttgggacgattgaggcgttgatggcagctagccaagaagagattgcggcgatcgactcgatgggcgatgtgattgcgaacgcagtggttcaatattttgagagcgacgaagttcatacactcatccgcgaattgcaagcagtcaacgtgaataccacttatcaaggccctagtgccaccgtggcagaagatagtaacagttggtttgcaggcaagcgggtcgtgttaactggtaagctggaaagctttacgaggccagatgcgactcaatggctacaagctcacggcgccacggttacgggaagcgtctctaaaaagacggatctcgtgattgcaggtagcgatgccggaagcaagttgcaaaaagcacagcagctggacattactgtatgggatgaagcccggttcagcgaaacaatgagggaggatgcacaagcgtgaatgttaaacgcatacgcacgattggcttagtggcagtagctgccattgttctagccgcctgcggtaatttaaagaattcgtcctttgggtcgactagtagtagcaccacaacgaccggaacgaaaacaacgaccaccactggaactgctgatagtgagttctatcaaggcgtcatcaaaaatggccgttatcggacgagtaagtcgcgaggcgtggtcgtttcgcaaaatgataacgtcatgaacttgaagagcttcgaaagtggcttattggacgtgtctaaaaaggtctttccaacgagtaagtatgtctttcaagaagggcagtatttgagctcatcgacagttgaaaattggctcggacggaaatcaagcagcaattcggagggcttgaacccagagaataacggtaagaaggatccgaatactcggaatccgatttacttacaacagcttgaagaacaagattatatggttcaaaatggtagtaagttatcgcttggcggggtcacgattggcttgggaatgaactcggtcgattattatactaaggtcgaatatggggcaacatacgaaacggacatctcaacgactgagttaacggcgcaaggtaagaagatggcgaatactgtcttacagcggttgcggcaacgctcagctttgaagaatgtgccgattgtcttggcactctataagcagtcttcgaatgatagtttagttgggggcgacatgattgcctacgcggtttctaagaacggctccacttcgatctcaaactggacgtcgttgaattggaagaattatgtcttcccagcgacctctgagtcaaagaactcaggtgcgaatagtaatgatgagtcggactttagtcagtttaagtcccacgtgcagaatttcttcccgaacttgtctggcgtaacggcgaatgctcattacaaggacaaatcgttgagtaaattaagtgtcaacatcacgactaagttctacagcgaaacggaaatcatcagtttcacgcagtacttagcaacggctgctaaacggtacttaccatctggtgtaccggttgaaattacggttaagagtgccaatggtgacattcaaagcttcttagccagaacggcgaagggtagttcgtattacacccatgtctttagtgaccagggcgacgattaaacaataatattgagtaagatttgagaaagaaggaaatctgatggctgaagaacgaattaatgccgaacaagtgcaacacgtggcgagcttagccaaattggagtttacaccagaccaattagcgatgttcacaccgcaactagaaaaaattatcggcatgttcgaagaattaagcacagttgataccacgggtgtacccgttacgtcacggatgagtgatcatacgaatacgctacgtgaagacgtggcagttaagagtgatgaagcactccgggaagcattgctgaagaatgccccagaaacggccaatggcttgatcaaagtgccagcaattattgatgaaagtggggacggtgaataatgacttattttgaccaagatctaactagtctgcacgctgacttggtagccaagaagatcagtgccacggaactagcgaaggccacttttgcgaatatgaatcaggttgaccctaagctaggggcgttcttgaatttaaatgaagaacaggccttacaacaggcggctgctttggatcagaatggcatcgacgcgaacaacgtttttgctgggattccgatggcagtcaaggataatattgtgacgaagggcctaacgacgacggcggcttccaaaatgttggaaaacttcgtgccggtctataatgccacggtggttgacaaactattagcaagcaacgctttgatcgttggtaagaccaacatggatgaatttgccatgggagggtcaactgaaacgtcggcgttccatgtcactcgtaatccttgggacatcagtcgagtgcccggtgggtcttcaggtggctcagctgtcgcagtggcttctggacaagtgccagtggcactcggttctgatacgggtggttcgattcggcaaccatcatcatttaacggaattgtcggcatgaaaccaacgtacggtcgggtctcgcgctgggggctgattgcctttggatcttcattagatcaaattggcccaatgacacggacggtcaaggataacgcggccgctttgaatatgattgcaggtaacgatgtgcatgatactacgtcatccaaacaaactgtaccagactttacggccggtttgacgggtgatatcaagggtatgaagatcgggttaccaaaagaatacatgggcgaggggatcgaccctaaagttcgtgaagtcattcaacaagcagtcaagcagtttgaagacttaggtgctacggttgaagaagtctccttaccaaacagtcgctatggtgtggctgcttactacatcattgcatcttcagaagcttcttcaaacttacaacggtttgacgggattcgttacggtttccgggctgacgatgttaagaatttggaagatgtctatgtccgtagtcgttccgagggctttggtgatgaagttaagcgccggattatgttagggaccttctccttgtcagctggttattacgatgcgtacttccacaaagctggtcaagttcggacgatgattatcaatgactttaataaggtctttgaagactacgatttgattatgggaccagttgcaccaacgccagcctttaagttgggtgacgaattatctgatccaattacgatgtatatgaacgatgtcttgacgattccagtcaacttggctgggttaccaggaatgtcagtaccagctgggtttgcagacgggttaccagttggcttgcaattaattggtaaggcgtttgatgaaagcacaatgtatcgagcgggctatgcctttgaacaagcaacgcaagtttacaagcaaaccccgaaagtcggaggtgctaactaatgaattttgtaaccacgattggtttggaagtccacgttgaattaaaaacgaactcaaaaatctttagtccttcacccgtgcaatttggttccgaaccaaatgccaacacgaacgtgatcgactgggggtatccgggggtattgccaacgcctaacaagggcgtggtcgaagctgggattaaagcagcaacggctttacatgctgaaatcgaacatcacacgtactttgaccggaagaactatttttacccggataacccgaaggcctaccaaattacgcaacatgaaaaaccaattgcgcatgatggttggattgaaatcgaagttgatggtaaaaagaaaaaaatcggtatcgaagagatgcatattgaagaagatgccgggaaaaacacccatgaaaacgactattcctatgtcgatttgaaccggcaagggacgccgctaattgaaattgtttctaagcctgacattacctccccagaagaagcttatgcttactgtgaagcgttgcggcaacggatccaatttacgggcgtttcggacgttaagatggaagaaggttcaatgcgggtcgatgttaacatttcaattcggccggccggttccgacaagtatggtgtgaagaccgaaatgaagaacttgaactccttcaactacgtgcgcaagtcgttagaatatgaagaacaacgccaacaacaagttctcatggcgggtggcaagatccaacaagaaacgcggcgttttgatgaaacaacgggccaaacgatcttgatgcgggtcaaggaaggtagcgatgattaccgttacttcccagaacctgatattccagcagtcgatatcgatgatgactggattgcatccgttaagaagaccattccagaaatgcctggttcgcggcgtgaacgttacatcaatgaatttggtttaactgcttatgatgcgggtgtgttgacccaaactaaggaaatgtctgacttctttgatgcaaccgttgctgaaggtgcggatcctaaattagcttcaaactacttgcaaggggacgttaacgcgtacttgaacgagcataaagttgatttgttagcgactgacttaacgccaactaacttagctgggatgatcaagatgatttcagatgaaaccatctcaagtaaaattgctaagaaggtctttaaggccattatggcgggctcagagcctgtccaatgggtcaacgacaagggcttagtccaattgtctgatccggcgaagttacaaccaatcgttgacgacgtattggataataatcaacaatcaattgatgactttaagaacgggaaagaccgggccgttgggttcctcgtgggtcaaatcatgaagaagacacgtggtcaagctaacccgaaagtcgtcaaccaactattaatgacatcattaaaagcacggtagaagcgttggtcgataaggtgttgagcctcgattgatgcatgtccagcgttggggtagagatgagacgctgaacgcttgaccgtgtgagcggaggaataggaaacatgcgtaaacgggcacgacttatttataacccgacttctggacgtgaggcattggcccacgatttagttgaaattcttggtatctttgaacaagctggttatgagaccagtgcgttcgcaacgacgcccgcccctaattcggcggctgatgaagcgcgacgttgtgccaaggacgggtttgaactgattgtagcagctggtggtgatgggaccatcaatcaagtagtaaacgggttagccgggttaaagcggcgacctaagatggctattattccggcgggtacgaccaacgattatgcccgggcactgcggattccgcgcaatgatccggttgcggcggccaaggtagtcctaaagaaccagacggttaagatggatatcggtcaggctggtgaacagtatttcattaacattgcggctgggggcatgttaacggagctgacctatgacgtaccatcacaattgaagtcgatttttgggtacgcggcatacttagccaagggtgctgagttattaccacgagtaaaaccagttgagatggatttgaaatatgatggtggtcattatcagggcaaggcttcgatgtttttcttagcgctgactaattcagttggtggctttgagcagttagtgccggacgcgtcattagatgatggtaaatttaccatgattattgtgaagacgagcaaccttgccaaaatgcttcacttaatgacattagtgctcaatggtggcaagcatatcaatgatccaagcattatttatgtgaagacgagcaaggtcgtcgccaaaccagctgacaaggatcgcttaatgatcaacttggatggggagtacggtggtgatgcaccgatgacgttccggaatttgaagcaacatatcgaaatgtttgccgatacggatcggattcccgatgaggcaatcacggatacagatccagagttggaagacgctgagcgacactttgtctcagccgttgatcagttgccagctgcaactgaggacgacgaaaaaacagaataacttgcttaaattaccgtttaccgatacaatggtggacggtaatttttttaaaagtgttaccgtcacagggacatgattgagcattgcctaacgatttaatcgtttgtcggtttagcaatgatttgtcagtggtgcaaagcatgagacagctcaaattcgcgcgttttgacactcacagtaagcaatttgaatagcatgtttaatcagtaaatgttaacgacactgccaagtgtggcagtattaatggccatatcactcgctgcccggagcagtggctaccaggcagtaactaaaaaataataagtcactaacaaagaaagcaagaggaaacaaatgaaagttaatttaccagtgcacaagggtgaagttttagacgtcactatcatggatttaacctatcagggtatgggtgttgctaaagtcgataattacccaatctttatcgaaaatgcattgccagaagaaaaaattacggtcaaggtcacgaagacgacgaagaactttgcgtttggtgatgtggaaaagattaaccaagtgagtcctcatcgggttaatcctaaagggcgcgtttatcgtcaaaccgggattgcaccactacaacacttggaatacagtgaacaattgaagtttaaacagcaccaggtggccgaattatttgcaaaggtccacatggatgatgtcgaagttttaccaacgattggtatggccaacccgacgcagtatcggaacaaggcccaagtacccgtacgacaagtccaaggacaactaacgactggtttttacaagaagaacagtcatcaattgatgccaattgaagattattatattcaagatcctgcaattgataaggctatcgtggtagttcgcgatattttacggaaatatcacgaggcagcctacgatgaattccatcatagtgggacgattcggacgatcatggtacggcgtgggtattacagtcatgagatgatggttgttattgtgacgcgaacgaaacacttaccaatggctgacgtggtcacacaagagattcaagcagcgttacctgaagttgtcagtgtgattcaaaacgttaattctaagaagactaacgtgatcttagggccagttaacaacgtgttagctggtaaggccactatcgatgatcagttactgggcctgacattcgccatttcagcccagtccttctatcaagtgaacccacaacagaccgaaaagctttatcagttagccattgatcaagctggtttgacgggtaatgagacggtgatcgatgcttattccggtatcggaacgatttcgttaacgatggcccaacatgccaagcaagtgtatggtgttgaaatcgtgccagcagccatcgataacgcacggcagaatgcggataagaatggtattacgaacgcgacctttgttttggatagcgctgaaaaagccatggctaaatggcaatcagatggcgttaagccggacgtgatcgtcgttgatccgccacgtaagggcttggacgccgactttatcaagagtgccggtgaaatggcgcctaaacgggtggtttacattagttgtaacccatcaaccttagttcgagacgcccaacggtttgcagaatacggctaccatattagtgccccggtccaacccgtggaccagttcccacaaacaccacatattgaatcggtaacggtgttagaacgcgaacaataagcattttaaaactggattattaatgaaattatgaaaagtgtgttgggtgcctgattatttgtcgggtaaccaacacacttttttactcagcttgagggctaactttgaattagaagcacaaaataaccgtttttaagcgctgatattgatttgaattcgtccgagtttaatagacagatcatttagaatcggctaataaaacagtttattgataattataattattgctttaaataatttaataaataatgcgctgtaattgctgtaaactagttcactggagctgtttgagtcaaatttagcgtattaaattaaataattgtatttattggtcaaaaaacacccacaaaaaccatcaattgtattacttttgataaaagtatgtatttcatctcggtttttgaccagtttgggttataatgataaacgaaataaaccgataaatgggggagcatgatggtaaagagaagaacactgacacaggcaaaagtattagcaacagctaatcagttaattgaaagcaagggaattaacggattaacaattcgggatttagcgttagttttggatgtgcggccgcaatcgatttataattatgttgatagcttgagtgatttattagatcaggttggcctccaatttgttcaaaatgttgcggatcgtttaactgaaacaatctcagacgttgacggtgatgaggctttgatggcatttgctcaagaattccgggcggcctgcaaccagcatcgggggttggcaccgttattacttgacttaaatgataacctaagaatcccacggtctcgtaaagcaattgtgcagctataccaggatatgtttaaaccattacaactggatgattcggcgcgggtggagaataccttgtaccgttccacgttgttcggattcattatccaagagattggcggcttctttaagatgcaggggactgaacttgatgaacggttcacgaaggttatgcagttagcgattgaccagacacacttacctgctgataaaacgaaaaaataatttaagattcagtgcggctatcttagcagatagccgtttttttataggttaaattcgccaatatttagcagtaaatggggcgtaatacaataatctttgttaaggctgaaatcaaaatcaataatgatttattgaagtagttttatgatcaatcgtaatgaaaatcttaattctgcatggtaaacgctaaattagggcgttattttagccccaggcttaaaaaatcgtttacaataaggttaaagttaattttaagggggcccaccatgtcggaacgttatttatcagcaattgaacacgggttaacgactaagcaagttgaccagcgcctgacagcgggtctaaagaatgagccgttaccgcccttaacgcggtctgttaaacagatttttcgtgataatttgctaacactttttaactgtatcaatgttttgttagctggattagtctttttgacgggaagttataagaacatgctgttcttattcgtggtcatcgtcaacacggctatcggtatttttcaggagattcgtgccaagcgccaggtcgataagctggcattattatcggccactaaggttcaagtccgccgtgacggtcaaacggtggcgattggtcaggacgaaatcgttcaggatgatttactattagtgacccgtggcgagcagattcctgtggatgggctcgtgcgggcgaccgctggattagaggtcgatgagtcccagattactggtgaggctgatccggttattaaggggccgggtgatgagctggtttctgggagtgtcatccttggtggtcacggaatcgtgcaggcaacgcaggttggtcacggcagttttatcaagcagatggcgcgagcagctaagcaaaaacggcggacgccaagtcaactgttaacgattatcaatcgaattatcaaaattttgacttttacgattattccactaggtgctggactgttcatttccactatgatgcggggtgaaagtcagaaccgggcaatcctcgggacggtggccgcgatggtcgggatgattccggaaggactggtgctgttaacgtcagtcgctttagctgctggggcgttcactttaggccggcaccaggtattggtgcgggagctacccgccattgaagcactggcccgggtcgatacgttgtgcctcgacaagactggaacgattactagtggcaagttagtttttgaacgcgttgagccgtggaaccagcatgatttgacagcagtggagcaccggttagctgcgttagtcactgctattgatgatgataatgaaacggcccgggccatcaagactgcttttggtcagccaacagtgcaagcgacagaagttcttcccttttcttcaagtcgtaagtggagtggggctgcgtttgatggtcacgcttacgttatgggcgcaccggaatttatttttaccacggtacccggcgagttacagtctcgcatcaaaacgctcgcgcaacaaggttaccgggtattagtgttagccgaagtggccgccttaacgacgcccaaaccgactcgaccgatgactttgggattaattctgattacggatgagttgcggccacacgctaagacgacgtttggtttttttgctaatcaagacgtcgccctaaaagttatttctggtgataatccggtgacggtcgccagtattgcacaacgggctgagatcaaggacgctgatcggctggttgatatgagtcaagtggggactacccccgactatgatcagctagtgacaaattatacggtgttcggtcgagtgacgccgcaacaaaaagagcaactaattaaagcctatcagcgcaacggccataccgtagcgatgactggtgacggcgttaatgatttgttggcgctgaaacaggcggattgtagtatcgcgatggcgagtgggagtgaagccacgaagagtttggctgattttgtcttaatcgattcgaactttgatgcgatggtgcaagtgctgaacgagggtcgccgcgttatcaataatattgaacgggtcgccgcgctctacttgattaagacgatgtattcggtcgctctgacgttgatttttatcttcatgagccacagctacccgtttgagcccatccaattaacaccgatttcatcgttgatggttggtattccaacctttttcttggcgttacagcctgattatacgcgaattaccgggcgctttatgaaacaggtgatggagattgccgttcccgcggcgatctgcgtggtcggctatatcatggtcatcatggtgttaggtaataagttccagctgaatttcgaaacgaccgcgacgttgagtgtgttgatgaccgggatctttagtttaaatgcgttattgattgcagcccggccgttgaaccggttcaaaattgggttagtcgtgttaatggcaacactgttcgtcctagtctttttgtttgccggccgaattttctcattggttaatctattagattggtcgttagctgtgatttacctaccactgatgatcagttcgtatccggtgttcattgttctgcaaaatggcttaggaaaacgcgttctcagcaagatcaattggcgataatcgatcaaatttaggtgacggggccacgctgcaattacggcgtgaccttttttggtgtaatcagatcgctgcgtcccccgtctcagcgtaagccacaccgttgttgaccagtcagattaaattaacagttcgatataagcctggttgataccagcatagcatgtaaatttataacagattttaataggcagcagcgtctaaaacggcttataatgaagttcagtagattaccggaatgggggcggtattgtgtggcttgatgaacaacggttaattcaacggttagtgccgcgcttgttgcgttttcggcaaactaacttctatcggattattcaacggaccttgatgttgacgttcccattcattttgattgggacgttcagtcaaatcattcaactgaccgtgttgacgaaaacggggtttattgccagtatctttcacctgtcaaaatgggtcccatactatcgttacttacactatccgtttgatagtttaacaaccttgacgctcaacggtgtggccgtagtagcagcatttggtgcggcaaaataccatgccaaactcaatcagcgcgatgaccaactagcgggattgaccgccgcgattgcgctattgatcgtggcttatcagtatacgaatcaaaatcaaattggtgtttttaacactttattgatcgggactaacggtctaacgggcgcattgattgtgggtggtttgaccggcctgctcttcaaatggttcagcaagccggttccggcacaaagtagtccgcatacggccgatatcttgacacggactttcagttcactacttccaatggccttaatactagtattggccgtgctagtgagcctcgctttgaactggctgatgattattacgtactctgctgaaagttggtcggcatttcaaaagtacgcaacgactagtcacagtctgtggctgacctttggcatggcagttgtgacgctgttgttagaaattcttggactagctggtccgtaccaagaacgcttggtgaccaatagtgcgacaatgacggccaatttgaattatgcactcacacatcactcggcgtatcacgtgccgtatccgtatacggccaacacgttgtatcacgcatttgggacgtttggcggaacggggatgttgctggccttagtgattgccatttatatcggtagcaacaatcataactaccacgtagtcgcgcggtggagtgtattacctgcgctctttaatagtaatggaccgctactgacaggcttaccagttctatataatccaatctatctaataccatttgtgcttgcgcctgtcgtaaatatgggactggcggcgctggcaattgggtttcattggattccacccgtggtttatccggttcccgtgggtacgccgggaccgttgattgcctttatcggcactaacggtaacgtggtggcacttttacttggtatcgttgatttggcactatcagtggtgatctatttgccgttcatgcggttggcggaaaccattgtgcaggcggcacaagcacaggtggggggtgctaagcatgtataatcgacctaattggcaacgacggcggcgaagtctgttagtgcttgtattaggcttactgtttctgggctttttgattcagccctcataccagtggacgaaaaccaacgtggctgcgatggcaggacgccatgattcgcagatgtcaccaattattatgattcccggcagtagtgcgacccagaatcggtttgacaccttagtcaagcaacttaaataaggctgatcatcgtcggcatagtttaattaagctgaccgtgatgacggatgatacgattaaaatgacggggtcgttgcgtgcccgtgataacgagccaatcatcgtcgttggctttcaaaataatcgtgacggctatgataatattaagcatcaggcccgttggttctcattggcctttaagaagttggctgccaagtatcaatttaataatttcaaagcaattggtcactcgaatggtggtctgatttatacgtactactttgaacactattttaatcgcgacgatattaaggtcaaacgaattatgaccattggctcaccttacaatttctcagaagctaatttgaatcataagacacaaatgttagctgactttattaagtaccgcgatcgattgcctaagtcagcgacaatgtattcggtcgcaggtaccgaaaactatgattcggacggtcttgttccagcgcggagtgtcgaggctggcaagtatatctatcaagggcaagtcaagcattttacagagattacggttactggtacgaatgcccagcactccgatttaccccaaaatgcgcaaattgtcacgttgattagaacttacatgttggataagccgaaacagactcgtaagggcttagtatcgacggggactgtcgaatgagcggcaacgaggttcagtcgttgtggactggacagtgttcaagagtttgtgacggtggcacctgtgaggaagtttagggtgttattaagaattgtggtaaaatttggtcatggaggtggccgaaatgtccacacaatcaccagtacatcgcaatcgggtcctgactttaattcggtcttattatccgaatttaagtgtgacggaccgcaagattgctgactatattattgccgacccaattaaaacggcggctcagtcgatttcagacttggctgccgcggttggcgtttcaacggccacggtttcacggtttgtcaaacggattagttttagtagcttccgtgacttctcacgtgaactaacggcggccgaaccgattgaacaaactaatgcggaagcttttcaagatgtcgaaaaacaaacgactttcaaaggaattgcggaatcaacattcaatagtattcgtagttcgctagatcagacaagtcaggtaatgacggaagcagatctcaagcgggcggtggaattattgctgaatgctcgctcgattggcttttatggtctcgggggctccgcagtcgctgccttagatgggtatcataagtttgtgcgcactggtattccgtgtgcccataatagtgactatgatatgcaactgatgcaagcggctcagatgaatgccagcgacgtggcagtggttatctcacataccgggcgtaatcagcaaacactacaagtgctagccaccctgacttcacaaagtgtgccagtgatcgcgttaactagcttcggtaactcgcccctggctaaggacagtaccgttgcctttatttcagttgcagaagaaattaattatcgttcggaagggctgacttcgttgattgcccagatgagtattatcgatagtctcttcttgatgactgctgttcatggcaatatcgaaatggcagaaagtcttggccgggttcgcgaggccattagtcaaacacgaacggagctttaaagctgtaggcaaaggattgatgagatgacaaagcggcaacattatcgaccagtatacgcaaaaacgcggtgggcgcggtggcgttatcgactgggctggttattagttctattagtaatcattggcagcgtttggggcggcttggcttggttacgttggcgtagtgacgctgtcgtgagtgggtttgatgtccgtggggttgctgtgtcacaaaatgacggttatttagattttgcggccttgcaaaatgatgggctcaagtttgtctatttacacgctactcaaggagctagttatacggatgataactttgcaagcaattatgaacgaatcgttggcacaagtttaggtgttggcgtaatccatacgtttagtttttcatcgactgctgcggcccaagcggcctatttcgagaaaacggtcggggatagcatcggcaatttaccaattgcgattcaagtgcaatactacggtgactacacggaccagacgattgcggtccgaaaaagtcgtgctaagcttaaggcattagtgaccacgttgacccaggattataatcgctcctgcgtcgtatggtcaacgcccgcagttgccaagcagatcgttaagcccgcactaaaagacactgacctatggctggacacggcgaagacccaccaacagggacgacgagtgatgtttatgcattattccgatcgcgccgtttaccgccagaacgggactcgtcaagagttcgctggaattctattcaacggtagtgtgacagcgtacaataaagttgtggcgcagggcttaaattaaggcctaatccttgaataacttatttcgcaaattaaattaacagcttattagctgctaggctgactaaaaataagtcgcaagttcaagactcttcttgaacttgcgacttattttgatggcgacctattaaaatccttaggacgtcactagcgtcattaggtatttggcgataagatgacataactgcgatcatcggcttcgtcaaagagggttacaggtcgttgctcattagcccgcacctcaaggtgaaatccatattgatcaagtaagacgagcgcactcgatgagatggattcgacggtggctggtaccgagcgcccgtcgatgcgaatcatcatgttgggatcaatctccaacgtgtggtcccggtgatgcgcctcatcacgataggtccaagttcccgcgtagaaaaccgctaagtcaccgtcagcgatcgtactagggtgccgtttgtggagtagtgtactagaaagtcctgcaagtaatgataaaccaaataatattgcgccacgccgcttcactggatcaaccttctttctgaataaatctatagttaaaatataccactaaaacggcgttaacgtcacgtaataagtggattcttattaaagcctttatgtcactgttacctgcgggtaatgaacgtaatatttgatcaatttcggaagggcggtaactaatttttttgaattaatttgtgttctgattggaaattactgggtgagtgtgttaatctatataatgtgattggcatttatgtgaagttttaaagtatcatttaattgtgttaccgtaaattctttataggtgttaataacatgtgttagttactttttatttttatatcctaggaggatttagttcatgaaaaatggtactgtaaaatggttcaatgctgataagggttatggctttattactggtgaagatggcaacgatgtattcgttcacttctcagctatccaaactgacggtttcaagaccttagaagaaggccaaaaagttacctttgatgaagaatcaagcgatcgtggcccacaagctgctaacgttgttcctcaataagcttagcttttaaaagggttgcccgcgtggcggctcttttttttatgcgcaaaatagactgggacttttaatccttctggcccaacttagcggcgaaaactggtaaaatagaactagaagctaaacgcacgagtaagcgccaccaatcacgactggttgactagcgccgttgagaggagtcaaatcgatgttaaaattaggaattataggaacgaatttgattacgcaacaatttattgatgctgccgctgcctctggtgaatggcaattgacgagtgtttattcccgccatgctgagaccgcgcaggcttttgccgccaagaatcatgccgatgagacttttacggatttagatgcatttttcagtcggggcagttttgatacggtctacattgcatcaccaaacagtctgcattttgcccaggctaaacaagcaatcgcctatggtaagcacgtcatcgtcgagaagccagccgtggcgaaccaaaaagaatttgaacagttagatgccgttttaaaggctcaccctgatgtcctattatttgaagcagcacgccagattcacgaagttaatttccaacgcgtcaagaatcagattaaaaagttatccttagttcagggtgcgacgttgacttacatgaagtactcgtcacggtatgacgccgtcttggctggtgaagaaccgaatatcttctcgttgaactttgccggtggggcgcttcaggatttaggcgtgtacctggcctacgatgcggtcggctggttcggcatgccggaagaggtggcttactacccaaccttgattcgaacgggcgttgatggtaagggtgtggctattttacgctacgctgactttacagtgaccttgaacgttggtaagactagtaattcgttcttgccatctgaaatcaacggtctgcgcgacgctattgtgatggacaatcctgctgaacttggacaaatcacttatcaagataaggatggtcaggagcatgcgattggggcgcaacccgataccaatcgcatgctggccgaggcgcgcgacttcgcaaccgttatcaatgacccaagtaatcatcagacggaatacttagcttggcggcaacttagtcgaaatgttaataaactattatttaatttgcggcagtcagggcacctatattttacgggtgaagcccctgataccgataaatagaaatgaggcactatgttagacgtatttaaaactaaatttgcggcggcggggttcaccgagttgtcgccgattcaaacggcagtggccgagccacttgcagctggtcaatcggtgttaggactcgcaccaacggggtctggtaagaccctagcgtttacgtggccaatgctcgaagcgttgcgggtcggagaaggcacgcaggcactgatcctagcgccatcacaagaactcgcgatgcaaacaaccaacgtggtgcgcgagtggggccaattgatcgatgccaaagtcctcgcgattaccgggggggctaatgttaagcggcagatggaaaagctcaaaaagcatcctgaagtaattgttgggacgccggggcggattactaacctgattgcggatgggaagatcaagcttgggcatctgaagatgatgatcgtcgacgaagccgatgaattactgacagatgaaaccttgaatcagattcgtgaaattcttgacgctacatttgctgaaacgttacaattaggcttcttctcagcaaccgaaactaaaattttagatgagttgccacgctggtttggtcagcatgttgaaaaaattgatgtgcgggccattgatcagacccagggggtggttcggcaccggacgatgcaagtgggtaatcggcaccgggtggacttactgaaacggattagtcgtgttgaccatatgcgggccctcgttttcttcaataagatgcaggaactccaacatgtcgccttagaattacgacaccagcacgtgagttacgttgccttgaccagtaatcaacggcaggttgaacgtgaaaaagcgttgcggttattccggcaaggcaaagttgggctgttgttgactactgatttggcggctcggggtctagacgtgcccgaattgccagctgtgatcaactatcagctacctaaagatgtcacgacttatattcaccggagtggtcggacaggccgcatgggtgctgatggactagtcttgacgttcggtgacgaccatgatgtccgcgactttaagaagctgatggcgacgactgactatgaaatcaagccgggttacttggtcgattatcatattgttgatacgaaaccagataaagttgttccaccgttaacgttcgaccatccagaagcggctggcaacgcggctaacggtcggcaccgggtcgtgagtgctggtcacccagatgaggttaaacgagtggagacgagccggaagcggcccgctgcggcaacacctaaaaagaagaagggtcacaataaacattctaagaaaaaagggatgcgcaagaaaaatcgtgatcgctttagcaatcagtaattgccaaaatgcacaatccgtgagatgatattttacggattgttaatggcctcatagcacaactggatagggcacccgcctcctaagcggttgatcccggttcgagtccgggtggggtcagttgaatattagaaagcaccgtttcagggcagcgttttagtgacgttaccttggaacggtgctttggttttaagtagccacaaatgatatgaaatcgaaatgaacactgtattagtctaaacgaggctgtgacataagtctctagaaacaaagcaggtctggaaaaatcttcggatttttccagacctgtttttgatataatagaaaataaaaaaagagcatcggtcgcacccgatactctacgaaattatcctcgaaaggacattcctaatatgcaagattattataacatgaatcaaaccactttgagtatcgccttggattaccaaccagaagagcatcatcctgctcgttacatcaaccagcttgttgagagtttaaaactaaaatatgattaccagtttggccgtccgcgggaatataacctcggtgccatgttaaaactggtccttttagcatactgctatggcattttcagtagtcgtaaaattgaacagtttgcccgtgaaaacaagccagctgggtggttaattgccgaccaaattccgtcctaccggacgatttgtcgctttagaatttctgatgaactggccactttgacaaccgatagcttatcacagctaacccaatatcttcgtcaaaatggcatgattgatgatgtttcatttattgatggaactaagatcctagccgacgccaacaagtatagctttgtttggaagaagaatacgatacgatttgacaagatgaatcgcgaaaaactcgttgacctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttggataaacgacgtgataaaatgtgtgaacaccaagcacagcaagctatttatgatcagtgtaacagttactctaagacggatcacgatgccacctttatgcgggtcaaggaagatccgatgcaaaacggtcaattaaaacctgcctacaacgttcaaatcgccacaagtaatcagttcattacgggatatcggcttttccaaaatccaaccgacacacgaaccttacaaccgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccacaaaacgtccggtttaattttaatgcttatcgtcaacggactgataagtatggttttacccgtgactttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcagctccagaaactggtcagatctacgctcaacgtaagatcgatgttgagccagtttttggcaagatgaaggcttctttacatttcaatcgattctcggtgcgaggtttcgacaaggtcaccaaggaagccggaatcgtaatactggcgttaaatattatgaaactggtcacggtagggaccaactttaaaaatcaaaggcgtaagcgaatgggacgagaaaccaaaattcggtttctcgtcccatttgcttatacagaggctagttatgtcacagcctcgttgcgattaacgaatgacgatgacgttgcaaggggcgtgatccacgacgtagctggtcgttgaaccaacggctacgcgatggggcgagttggtaccagtggcgccgagcacgatcaagtcaatttcgggatgttgcttggcatagtcctcaatggtgtgttttggaatcccgtagctgatttcagtttttaaattcggtgcggacgtggtggcgacgaattgttgccgctgccgcatggcatccttggcatgagcggcttccgcgtctagtaattcagatagaaccgggtcgagtgcgggggtgtggtaggcgctgtcatccaccacgtagagcgcagtcaggtttgcttggtgccgctgggcaatgttgaccgcttcagtaaaagcggcttgtgcagcatcggaactgtcaacgggtactaaaatatttgtgtaacggcttggcattataaccacctccagttatctttacgataattataatggattagtgttgggcaataaaattaaacgcacctagtgggcaaggtcgatgaactagcgtatattatagacagtaaatttcttttgggggttaggtatgttaaagcatgtacagaacagcctattgacctttgaacgggtcgttgagcggcaacgttattggcgcgccttacgtgatacgttgacgctgctttttccattcgcattagttggggcgtacgttagttttatgaaccaggcaatctttcaacacaatggttttttgaatcatatttattatctcagtcactggctgccggggtttaaacatttggcaacttacacgacgatgcttaatctgagtatcaacggcatccttgccgtgattgcggctttttcagccgctaattttgtcgcgcggagtgcccagcgtgataatctgttagcgggattgacggcggcaattagttttatcatgcttaatatcaattataatttttttagtacccagggtcagcctgctggcagtcggtttttagaagataatttgggaactcagggcatcttcctcgcactattggtgggcctgttgactggttggttgttcagtcatttgacacggtatccacacatccaccaggagatcgagacccagacccacttgctagcgcgggcacacgcgaactggttaccgatagtcgctgctttgctggtgttcagtgccatcgggtatggtattagttttgtcagtaaagggggattaaacggcctgttttacgcggtcttcaccttaccattcagtaatccgggggcgtcgctactagcgataattggcgtggcatcactcagcaatttatactggttaattgggattatcggtccggttgactttagtggtaacagtactacgagtacggttcaaaatttggaatatgcgttgcaacacggttcggcgtggggcgcgccaaatccagtaacgctccatacgttatttgatgcgtttgcgaacgtaggtggtcccggaatgacgttagcgttattgattgcaattttgtggcgttcacgtaaccgtaattatcgaacggtggccaagaccagtgccttgccagtactgtttaatatcaaccaaccgttgctcgtcggcttaccgattgcttatagtccgattttagcgattccgtttttgttagcgccactggctagtatggtcatcacgtggtgcgcgttgaagcttcaatggatgccgccggttgtttatccggttggtagaacgatgccgggcttcttgaccggttggctgggaactggtggcgactggcgggctttcatcgttagtctgatcaatatagcggtggccacagcaatctacttgccatttgtcttactggcaaaccaggttgaggaggaggcgaaggcggatgcttaaacgatattggtggcggtggcttcttggaatcggtttgttagtcgggatctgttggccggcctacacgtggactcaagcgaatatcaagacgctgaaaaacactggtcggacgcggatggcaccagttattatggtccccggatcgagtgcgtcacagaaccggtttgatagtttgattaccgagttggggaaggaaacgccgaaaaaacacagtgtattgaagctgacagttcagacggatgggacaattaagtatagtggttcgattgctgctaatgataatgagccgttcatcgtgattggcttcgcgaataatcgtgatggtaaagctaatattgataagcaagctgtctggttgaatacggcattcaaggcgttggtcaaaacgtatcactttaatcacttttatgcgctaggtcattccaatggtggcctcatttggaccctctttttagagcgctatctaaaggaaagtccgaaggttcatattgaccggttaatgacgattgcctcgccgtacaatatggaatcgacaagtacgaccgctaagacgagcatgttcaaggaactttaccgttatcggactggtttgccggaatcgttaaccgtttactcgattgcggggacggaaaactataccagtgatgggacggtgccgtataacagcgttaactacggtaagtacatctttcaagatcaggtcaagcattttacggagattactgtaacgggggcgaatacggcgcactccgatctaccacagaataagcaaatcgtcagcctgattcgacagtacttactggctgaaacgatgcctgacaaggttcgtcaaaaaaacgcacaacgggtacaaaattagttacgttgtgtggcagtgatactgctgttaagacaacactggtgagcgatctggttaagaaagttatacatgcagtgaatagaacgacaaaaacgattagcgtcccgtaaccgggacgctaatcgttttttagttagatttgcaataaattaatgatgatgcctggcgttgtgtgagcgggctgaccgtttcgagtagtagtgcttcgacggcttcgcccggtgcttgactcgcattgtgacacgggttccccgaactcgcaaggcttgtgcattggttgccggcagggtcagtaaaccgccacagacgaccaggatgacgagcactggtaatcctcggtggatcgacatgatagaacgcccccttaactaaaatccttatttagtgtataagtaattcgagtcagcgtcaacctaaggtccgttactgactttacaaaacgttaacggcatattaacggattattcacaaaaagccggcaaatttgattgtattttgccaagttttcctttatggtgggagtaatatataaaagggagtttggctaaatgaatattgaaatcttaaactcagcaatccaagacttacatttccaaatcgtttatgatcgttctgaagacgatgacaatcctggtcagggtcaattcagctatacgaccgccaatccagatgttaagaagacgtttggcgatgacgttgtgcaggcccaattacaagtgacctataaagaagaaatgttcgacttatccgcgaccgtttttgcgattgtacgcctaagtggtgagatggtgggaattattgaacgtcaatctgacaacaaatcaattgaagacgacgaacaagaaatgttgaacaatttgaatggtgccatcattccagcgttgtctgccaaagtccgggcctatgcagcattattgtcaactgaagctagcaactttgccatcatgccagctgactttgatgatagccagcccaatgatgctgaataagcgtaatccaagagcttgtcaaactggcaagctttttttgatggcttaaggaatgagttctagcgttgtgtaaccgttaacaaaggtgctataataatgatggtcagagttgactaggcaactgcggttgcaatgacgaggtcagaaggtctgattggtgacttcagcaattattactttgatccaggcttatcggaatggttcaaagcgggggtgaccgcgagtcggtcagcacacataggggcagtgaatattgacacatagtttgagccaagctggtaagtattgtggtggccaagttacgctgtaatttggccgctatttttatcttgttttcagacgaacactgcgacaaaaaatgaaaactgtcgtgatgaaatcactgtaaattgtcacatgaaagcgtatactgacggtgagaggggtgagcgttatgtttaaaccaatggcatctgtttttacgaaccatcaaattgcgggtcattatcgggccattgagcgggcgcaaaagtgcgtggtcccatttcattttgagattcagggacaggagtatccaaagccaaaaccagaacgtaactggttacggcgcttatcggggacgtcgagcgaaaagtacgcaattgtcgaactgaccccgacaaaggtcgttttgtggtcaccagaaggacgcaatctgggtgaaatgccactgagtgcggtgcggcgaattcagatcggtgcgattcggtgtcacgtaacggaaggactcgacccacgccacgcatttcgggcgacgatctttgtgctgactgatagcggtaattattattttgctaattctgatatggaagttttaccggcgatttgtaagttcgcccatgaacatcaagtgccggtagaagacccactgcggttgattccgcttttgaaggtcggctggcgggtcgcggccgtgacgttacatgaaacctatgcgcaactggttgcgcacacgggttatccggctgataaggtttaacttgattttatgattaataataatgaaaaacggactgtcgataatgacaatccgtttttttgatgcgattaaatgtagttggcttaaactaagccttgcgctaacatggcgtcagcaacttttgtgaagccagcaatgttagcaccactcaggtaatcaccgctaacgtggtattcgtcggcagcggcaacggagtgtgcaaagatatcttgcatgatttgcttgaggcgattatcgacttcttcaaaagtccagctcaaacgcatactattttggctcatttcaagggcggaaacggcaacgccaccagcattggcagctttggccggaccatatagcaagctggcagcttggtatgccgaaatggcttctggactgctaggcatgttagccccttcggcaacgaccttggcaccattggcaatcaagttcttggcttgatcaccgctgatttcgttttgggtggcgcaaggtaacgcgatatcataagctacttgggcgtcccagacggaaccttcgtaatagctggcactggctacacggtcggcatagtctttgatgcgaccgcgttcaacttccttgatctgcttaacgatcttgaagtcgataccgttttcgtcaataacgtaaccgtttgagtcggagcaggtaatcaccttgccaccgagttcttcaaccttttgaatcgcgtagatggcgacattaccagcaccagaaatggcaacgcgttgaccagggaaggaaagttggttggccttgagcatttcgttggtatagtaggcgagaccataaccggtagcttcagtccgggctaacgaaccgccatagttcaatcctttaccggtgagtacgccgcggtcagcgccccggagtcgcttgtattggccgtataaaaagccgatttcgcggccaccaacaccgatatcaccagcaggaacgtcagtatcgagaccaatgtacttgctcagttcggtcatgaaactctgacagaagcgcataatttcgttgtctgatttgcccttagggtcgaaatcagagccccctttaccaccgccaattggtaggccggtcagggcatttttgaagatctgttcaaagcccaagaatttgacgatactcagattaacggatgggtgtaaccgtaagccgcccttgtaaggaccgattgctgagttaaattgtactcggaacccacggttgactcgtgcatgaccagcatcgtcgagccaaggaacccggaattgaataatccgttctggttcggtcaaacgttccaaaatattggcttcgatatattctggatgttgttcgaggactggcgtaatcgttttgaagacgtcgttgatggcctctaaaaattcggtttggttcggatcacggtgttcaatgacttggtaaacatgttggacataatcggttgcttgactcaatatgatcatccttccttgaataagttaactataatcttcattttaatggtcacgttcggaaattgcacgagttaaattaactaaattttgatgaatttttagtgattgtggtaaaaccgtgatgttgatagcgcttgcaatttggttcggcggactaacaataattcgcattttaatgcaaagtcagaagtgagggcgtatgcttggggcaattaaatagtagtcaagtcagatttgacgggcgactcatcaggaacaggggggatcatgatgaacaaacggcgttggttattaagtttattgccaatcttactggggttgattggcgtgggtgtgtggggatcacagcaattaggccaaggagcacagcaagtgacaccaaagacaattaaagtacagcaggcagcgtcaaaaatcaaatccgcgacgaaaaagcaaacgacgactaagcctaaagtgaagcccggccagcttactgaggcccaggcaatcaagcaaatcgatcagttgatcaaaagtcatcatattatggggacactattactgaccacgaacggtccggcgggggtccgggttcgaacgtatggttatgcggatgatgccaatcaagtccgcaatactgcgacggaggcttatccattagcgtcattacaaaaagctgtgactggcgtgatgattcaaaaactgatcaatcaaggtaagctgagtctgacaacgaagctgagtcacttttacccggaaattccgtacgccaaccagattacgatacgtgaactattagaccatcgttccggtattcggatgactgagataacaccaaagacgattttaccaacggagacggcgcggctgaactttacactgcaacatttacggtcgacgaataatcatgcttatgcctattccaacgcgaactttaccttattggcaggggttattcgcaaagtaacgcataaatcctatcaggcggctttgactaatgacatcattcggccattgggattaaaacatacctatgaatataacgatattccgggcaatgtgatcaacccgacttcgtatcgcttggctaatgggtttggtcagagtggcatcatttctaagccgttacaatctagtgaattaggctgtggtagtctatatatgagtgtgggggattattataaatttatgtatgggcttcaaagcggccagctagttggcgaagccggtttaaagtcacttgcggataattttcaaattaaatattcggcaggcgtttattaccaggcaggccagttgattcgagtgggtggcaatgacaataattttcatagctactatatggggtcgcgaaatgtcaaagtcgccttagtcttatttgaaaatcagggtgtttttggtggtgacaaccaggtagcgtataagattcgtgatattttattgaagacggtacctttttagaaacggtacgggctgaacatcatcttaattgcgggagaacgtgtgcctgcaatcaaggtggtgtttttgcttacccgtccgtttggctgaatccttgaaaataactaaacttttactcgaaatgatggcgccacgacgtaactaacgctatgatgagattagaaactaaatgatgcaggtgaaagttaatgacaaaaccaattaaggtaatgacgattttcggcacgcggccagaagcaattaagatggcgcccatcgtgttgcagttgcagcaacagccacaatttgaaccggtaacggtggtgacggctcaacaccgcgagatgttagaccaggtgctcacgatttttcacattacgccggactatgatttgaatatcatgaagcctaatcagacgttagctggtatcaccagccgggtactgacgaagctagatgcaattatggatacagtcaagcctgatatcgtgctggtgcatggcgatacaaccacgacgtttgcagctagtgtgagtgctttttatcatcaaatcccagtcggacacgtggaagcggggttgcggacgtggcagaagtactcgccatatcctgaagagatgaatcggcagctgaccgatgtgctggccgacatgtacttcgcaccgaccgaattaagtcggcagaatctattgaaggaaaaccatccggatgcggccatcacggtaacgggcaatacggccatcgatgccttaaaacagacggtctcgatggactatcaacacgctgcgcttgatttgattcagcccggccaccggatgatcttactcacgatgcatcggcgtgagaatcagggcgccccgatggaagcggtctttaccgccatcaaacgggtggttgcccagcatcccgatgtcgaagtggtctacccagtacacttgagtccggcagtgcagacagtcgccaaacgtatcctcggccatactgatcgtattcacctcattgaaccgctcgatgtgcttgatttccacaatatggcggcgcgcagttacttcattatgacggattcgggtggggtgcaggaagaagccccgtcactgaataaaccggtgctcgtattgcgtgatactactgaacgaccggaaggggtcaccgcggggacgttacgattagtcggcactgatggtcagcaggttgcggcagcaatgaccagtctgttagatgattccgcagcgtaccaacggatggcagacgctaaaaatccttatggcgatggtcatgctgcggaatacatcttacaagcgattatgaaaaaaattggtacacattaaaattatttacatttttatataaacagtgtaatattaagcactgacatagtgataaaagttttcatttcttccgtaaagatgtgaaagagccggatatggatgccgcgggggtatcaataccggttatttttttgcgttaaaatttggatgggcccagtactactgagcgtctaggtagctatttgattttggcaaagtggctgacggccggaagataagcggattttactcatcagtggtcaggtattgccatcaattgatctgattggaccgactagtcgattcgccgaaagcactaatcctagtataaaaggtgtttcccgcggcattccattgtataattgtaaatactataagtgagcgttgaggataaatgaatgaatttaaaagcccgttaccctaaaattgcgaaaagcctggaaattattattcggcggtatggacaagccaatgtcagcaataatgcgattgtgctggcctactacgcgttaatgtcgattgccccgattatcttgattgccggaaacctcattgcccggttcgatttgaagtctgggcagattttagcgtacgctcaggaagtcattcctagtaacgtctaccagacgtttaagccgattttagtttcattcctgtctagtggcagcagtagtagtttgtcaattgggattttggtgacagtctggtcggcgtctaaaattattgctgcgattcgcaggagtctaaatgaggcgtacggggttacagatgcccaaaatgccgtttggacgcgaattattgcctttttcttaacgttgggactattactcctaatcgtagggctggcgattttcttcacgttgagtcagttgattctagatgtgatcttgaatttaacgaacctcacgcgtgcaatcattccgaattggattaatcagttattggaaaataaaaacttgattacctttgttgggatgttcgtcgtcgccatgttgttgtattactttgtaccgaacgccaaggtgaaattgcgttacatttggacgggggcgttagttacgacgattggctggatcgtgatctcgcaagggttccgggtgtacatcgaattatttgctaaacggattacgacttaccaaacgattgggagtttaattgtactaatgttctggttgaatttttccgggattctcttgatgtttggtggcgtcgtcaatgcgtcggtgcaggaatggtttgagcatacgattgagccaaagtctccacggatgattcgtcgcatacggcgacaattcttcaaacgcaaaaaaacggctaaaaaagaataatcagaaccttttaattgaatccgaacgtttaatcctgtaaaatcaaaactttttgcgatttacatattaaacgattcggattttgtgtataatggtgttcgtgtgaaaaaagtgccggtgctttctgaaagtaagtggcgtctatttcaaaataaacaggcgtaacaacgccacaggaggagaaagatagtgattcatcagcttttggcagagttcatgggaaccgccttgatgattatttttggtgtcggtgtacattgtagtgaggttttaaaggggaccaagtatcgcggttccggccatatcttcgcaattacaacatggggttttgggattacaattgccctctttattttcggcaatgtctgtattaacccggccatggtattagcccaatgtattttagggaacctttcatggtcattgtttatcccatattcagttgcagaagttttgggtggggtcgttggtgccgtgattgtctggatcatgtacgcggaccattttgccgcttctgctgatgagatttccccaattacgattcggaacttattctcaaccgcacccgctgtgcggaacttaccacggaacttcttcgtcgaattcttcgatacatttatttttatttctgggattttagctatttctgaagtgaagacgccggggatcgtgccgattggtattgggctcttagtctgggccattgggatgggactaggcggcccaaccggattcgccatgaaccttgcacgggacatgggcccacggattgcccacgccatcttaccaattaagaacaaggctgacagcgactggcaatatgggatcattgttcctgggattgcacctttcgttggggctgcttgtgcggcgttgtttatgcatgggttctttgggattgggtagataataaggcataaattataggaaaagcgatcatctatggaggtggtcgctttttaacagtgttaaaacgataatcttataattagccttttacattcagttatttttgctataatggtgtaatgagattttgtatttttggaggaatttaaattgagcaagtatgattatttagtcgttggtgctggattatttggtgctgtttttgcccatgaggcggctttgcgtggtaaacatgttaaggtgattgaaaaacggaaccatatcgctggtaatatttatacaaaagaagtcgatgggattcaagtacatcaatatggtgctcatatttttcatacttcagacaagcaaatttgggagtatgttaatcaatttgccgaatttaatcgttatacaaacagtccagtcgcaaattataaaggacatatgtataacttacccttcaatatgaatacgtttagtgaactgtggggagttcggacacctgcagaggcacaagcaaaaattcaggaacaaaaagacgctgctcagttaagcggcgaacctaagaaccttgaagaacaagcaatatcgttgattggtactgatatttatgaaaaattgattaagggctacaccgaaaaacaatggggccaaaaggcgaccgacttaccagcatttatcattcgtcgactgccagtccgctacacatacgataacaactacttcaatgatacttatcaagggattccaatcggtggttacacgcaaatcgtcgaaaaaatgttggatcacccagaaattgatgttgagaccggtgtggatttcttcgccaataaaaatcagtatttagccgactttccgaagatcatatttactgggatgattgatcaatacttcaattatcaattaggagaattggaatatcgttctttacgatttgaaacggaagaacgagacgttgacaactaccaaggaaatgctgttattaattatacggatgcggaaacaccgtatactcgaatcatcgaacataagcattttgaatttggaaaaggtgacaagggtaagacaattattactcgtgaatatccagctaactggaaacgcggagacgaaccatattatccagttaataatactcgcaataacacgttgtataagcaatacgctgaacttgcaaagcaggagggcaacgtgatttttggtgggcgcttagggcaatatcggtactatgatatgcaccaagtgattcacgcggcattagttactgttaacaaaatttcaaatctataaaggttgggcgttgagactttgaacaaggtttttaaaatagcaaagaaattttatactgatataaggtattattcattccaattagcatgtattcatctaggggaaacatttagccggtatacaaaatttaacttggcagataaatattatttaaaaaaggataagatagtactaaattatttacgtactagatacacaaatagccctaagcaggatgtatatggaggagtaccgaaaatatatcaaccaatatgggtattttggtatcaaggggaagaacagatgccaaagcttgtaagcgcatgtcttaaaagtgtacgtaataatgccaatggacatgaggtaattttaataggcaaattacaagtttaatccgaacaagcccggaatctttcaatggcagtctgttgatgatgtatttttaatggtcgttgattaattagttcaagtgctgctaggatcccatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgcccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccaatatcaaagaaaaatatgaataattatataaaaattcctgatattattcgagatagagtcgagtccaagaaaatttcgatggcacaatacagtgatattattcgaatgtgtttgttggcagagtatggtgggttgtggattgactctacggtgcttgtgactcagttaatcccccagtatatttttgagctacctttgtttaccataaagaatagtccaaatcaggaggatccattatattttattagtgtatcgcatctgagatggactacatatgtaatgggcggtgaacctaacaatgcgttgtttacattcgttcgggatctattaattgaatataacagtgtggaaaatgcactgattgattatctgttaatagactatgcgattgagctcgcaattgaaaagaattctagcatttctgatgatatgataaaaattccaatcaataaccagttaaaggaagaacttgtgcacaggttgttttccatttatccagactgcaagacaaaagagttattacagagtggtactattttctttaaactttcatataaaaaagtcgcgccaaaagtaatagaaaaaaacaattatcaattactggtagatggtgatttatgtcaagcttataacatggggaattaagataatgaaaataacatttatattgccaggatttacacgttttccggttggaggatatcaaattgtttatcaatatgcaggttacctttctagtaaaggttacgatgttgaaataattcatgctatgtttttacctactcaagaaaaaccaggtatcaagaaaaaaatcatatatagtgtgaagagtttcctttttgcattacatttgataaggccttggtttcaaattgactctcgaataaaagtactaaacaaaggaaaaattctgactaaagacgttcgaaaagcagatcgcgtaattgcaactgcgtgggagacatcagaattcgtttcattgttaccttcagaatgcggagaaaagtactattttattcagcattatgagacgtggggggggaaagaacgagttgataaaacttggaaattgcctctgaaaaagattgttattgcttcctggctaaaaaaaatagcatctgaaatgcaagaagaagcagttctagttcctaattttgttgagcaaaataatttttttgtgactaaaccaattaaagatcgtacacctacaatctcgatgttatatagcgagcatgagataaagggatctaatttaggaattcaagttttaaaaatgttgaaaaataagtattctaatgtacacataaaactatttggtgtgttcgagaaacctgataatttaccagaagggacgatgtattatcagaatccaagtcggaaggttctccgtgatgagatttacaatgaatcctctgtatatctttttccaagtgtctctgaaggctgggggttaactgcaactgaggcgatggcatgtggagcagccctatgctccactgataatggtggggttgatgattttgctgttgacggcgaatcggcgttaatatcgccagtcaataatgctgaacggcttttcaaaaatttggaaagattagtaattgatggtgaactaagaaataaaattgctgtaaatgggcaacaaaatgttttgaagttaacattcgattcgtcggctcatttgtttgagcatgcaattgatttagcgtaatctaggaaggtaaattttattaaggtatgaaaataatacgtaactacttgtataacgcaagttatcaagttttaattttattgacaccattaataacggtgccatatgtcgcacgagtacttggccctactggagtaggtgtttactcatatacgaattcaattattacgtattttgtgttaattggaacgcttggaataactgtatatggtaatcaacaaattgcttttcatagagatgatataatagagcgctcgaggactttttgggaaatcgagttattacaagccgtaaacgttggaataacttttctaggatttggtatctttttgattcttgatcatcgttatcaactatttatggtctttcaatcttgccaattattagcaggagcgtttgatgtgtcatggttcttcatgggaattgaagattttaaaaaaacagtttttcgaaatacattggtgaagattgcaacattaggtgcgatttttattttcgttagaactcaatcggatctggggttgtatatacttatattggccctgtcacaactagttggtaattttacgttgtggccctatttaaaaactcggttggtaagaataaaattcaaagatttgaaaatttggcatcattatgtcccagccttaatgttatttgtaccacaagctgctaatttggtttatcaacaagttaataaaacaatgcttgggaatctggatactgttaactctgtcgcgtattttgattacgcagataaattgataaagacagtgctagcggtagtaaccgcaaccggaattgtcatgttacctcatatggctaacctgcacgccaaagggaaaaatgaaacgataaaaaggtatttgtacaaatcgtttgaatttgtttcaatgatagcattgcctcttggatttggaattgcaggaattgcaacaacgcttgcgcctatttattttggacaagactttagtatttcaggaaaactgttaataatagaagcccccgtaatacttttgataggttggagcaacgttattggacaacagtatatgatgcctacagaacaaatttctaaatacacaaaatcagtaattattggagcaattgtcaacgtgattttaaatgtgccattgattatgtatttaggcgcagtaggtgctccaattgcaactgtagcagctgaactatctgttacgctatatcaactattcgttgtcagaaaacagatacaaatcaatttattattttctgatttttggaagtacttattttcatcaatagtgatgtttattgttgtttatggtttaaatgtttcaatgccaatgtcaatcattaatctaattgtacaaattgttgaaggaatgattatctatttaggtctgttgctggttcttcaaccaaagttggtagtagagggtaaatcgttattgttaggaaagcttcacaaataggaggttcaaaaatggatattaagatactggttgcagcacacaaagaggcaaagatgccgactgataaaaatttatatttaccaattcatgtgggtgcggctttacatccagagttgcgcttgggctaccaatcagatgctacaggggataatatatccttgaaaaatggttcatataacgaattgacagcaatttactgggcatggaaaaatttgaatgcggatgctattggattggttcattatcgacgcttattgagtctaaatcacaaaaagagtttttcctctgttctaagtaatcacgaggcacaattgctgctgaaaacgcatgcaattattttacccaagaagcgacattattggattgaaactaattattctcactatgtacatgcacattaccgtaatcctatagatgaatgcagacgggttattctagatttatatcccgattatattccattttatgatgaggtaatgaaattacgatcagctcatatgtttaatgtttttattatgcggcaaattacaagtttaatccgaacaagcccggaatctttcaatggcagtctgttgatgatgtatttttaatggtcgttgattaattagttcaagtgctgctaggatcccatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgcccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccatgtgaataaatttaattagctgatacttctgaaaaaaggaacagaattattaatatagttcagatggctaggtccaattgcattcaacaacataacggggcatgactgttaaaattttccaagatacgttaactgggagataaaaaactaatcgagggactatataagtgaagtttcaaagttaaaagtaactcagattggcaagcgtacatcgtattgtgacgtatgctatcaaataacacttggtcataagatagcctactagtgttaaagctacatttgatgattttcggaaaaggatgttatcagagtttgattggtggtaggccaggagtttgtggaatcttatcattgtgccagatgatgagtttgttagtgtattggagagtagtatattatgggacaataacggtgaattatttgattgagagattgcagatgactgtcatgcccgttttctttaatattggtgatttcaaagctttcaagctgttaagcaatttgtgaatgaatatttgctagatattaaccgtgtattaatgaatcctttttggagtaaacgttacccgattcaaagtcaactttcaagggtgtgagtcatacctgtacaatggctgattattacaatggatgctgatattggcccatagtttgaaagtaagctggtaaattttagactgttgcggtggttttctcgcgtgatttttcacacattccccctaggttttcctcaccgttcaaggtacaattaaattagagctcaaattcaagtgaaaaggatgtccgatatgaatgacgattggatcacggtttttcccgcggattataataattcgtaccacttaattttgaaacgggggacggcccattatgcgtactactactttaaggttgataagctagatcaacgggtcattttctatgatgacattgagcgtagcggtatttcgatcaagactcagatcacgcggacgtttatgcgggcactggttaaagcgattgattggcatccggtcggtaacagtattattatcgagatttaccctgtcgaccgtcaagagacgaaagcgatacggctatcttgtgatatttagctctgaagtgattgccaagagtaagatgactttaaatgataaccaaagaatccccggtcaattactgaccggggattcttgtaattgcaggtaacgcgaggttaagcctttggtgcagtgacgattggtgtctcgatggtttcgacgtacttagcggcaagcggttcggcgactaagttttcgccatctttcacgaatagcttggtggcagcgaggtccgccattgccttactaacaacgtctttactcaagttgtcgttggcgtagtgtaacttcaagtggtgaaccttgtttgtgctagtcttaaagcttaagtctaaagttttcatgggcgcttcctcctattattatgggtgtgttaagcgatgggttgtggatcgtagcggtaggcgttggccaagttagcggccgtgaactggtcgcccgtcaagacttcgacgatcttgccaaaagcggcaagttgttcgtcagttgcgtcttgggcgattgcgttaaaggtttgcttacgttgttcgtccaattccgtagttgtttgaacagtcagggttgcttttaaccaagttttagtcatgatgagttcctccttgaattttgtggtggtaggctggccagtttacattaatacagacggttgagcctgacgatttgtgcaaggtttgcctaaacttttttgactagcacccatttaatccgcaaactcggtgatggttcgaacggtaatactgatgatcttctcagcgaatagtggggtcagaatggtaatcaagctagtaaagtcgctgtctgtcagttcgcgacctgctaaccagtgttggtggaattggcgttgattagaatcagttactgtgagcagtacatgtgtgttcatccaaatatgcatcgtgagttcctttcagactgcgacagtcttgttagttaattggtggtttgttgctggtaaagcttgtgggccttgacgagcagactggcccgccagttgtagactgttcggcggctgacctggtggcgccgcatgatactgctaacggtctgttcttcgaaaaagaattcggtgagataaatccgctcacctggccgacattgaacaaggagttctgttaatagggcggttaattgccaatgggtctcttgttcggtcatgggatcaatggtaatgggtagtgcgtgttctaagttgacttgtgactgggtgcgcaaagtttgtttacgtagatagtcgacagttcgccacttgatacggcgaaatgcaaatttacgaaaatctggtaagttagcgggcaattcgggcgcgtagttctggtaagcagacagccaagtcaggtgggccacggttacacaatcttcgaattgcgggtggtatttggtgacttgggcggcttttaaagcgccgtatagtaaccgttggtgctcgggtcgggcgagtaaatcgaaagcaatttgattatcaaaacggtcagcgtgcatctaaataaccccatttatgagcgatttccttggccaaggttgatatcagtgtagcgagcggtcgcaactgacgcaggtcgtgaaaatggactgaaaagtgacgatttattttcattattaatgttccaatgagatttggatagattacagaccaaccactttcctagattgtacgtaattgttatgatgtgattaatctaaaataaccgcggacagcgggggctcggctggtgaatgttagagataaataccgactttgagggggattttccatctatgaaccaaaatattgacgttccgcatcacgttaacactttttggcagtgccacgctggtacttgggacacccgacagccacaacgattattagtcatcgcgcaacgctcagaacttgccacaatcgacgtgctggagacactttttctacttgacataaaacacctgacatgtgttgaaaatacgctaatctttgatcgtcaacggggattgatcaagacaaaactgacgacgcgccagatcatgatgaattacgctggccgtctggggttatctgggacacagttgatcaagcaactcgccggtgaactcggtttatcgaaacacaagttacctgtgattcacggtgatgcgatcctgatgccgttaagtacggccaaacggggaacaaccagctggtacaatcggcattatttgaagcatatcgaggctcaaggatttatgacggccttagtttatgatggtcaaattacgattcaagtggatatgagcgagcgcgtggccactcgccaacttgcgaaggctggtcaattacaagcagcgctacaggaacatcatcgccggcgattagtgcccgatcaatcggtaccttcaatggcggacgcggatcacgagatgatgcagtcgtatactgaccaagtcttaaagcactttggcatcttagcacttcctggagaaattagttgtttgacgcggcgatttttcggtaaactataggagtaaagattaaatgatgggagttggtgtcgttgactaagaaagtcacgaagattgtcgcgcaaaagcgagctggacgttataacatttatttagacgagcagtatgcttttccaatcagtgagtcggtgatgatcaagttccgcgtttttaagggcatggaagttgatgaacaactgcaagcggcgatgattgcggcggacgatgtctccaaggcgtatacgcgcgcgcttgattatctctcacatcaattgcgtaccgaaaaagaagttcatgacaagttacgggatgaagaaattgacgagtcggttatcgacgcgacgatgcaacaattacgtgagttgcggttattgaacgaccaacagtatgcggatgcctttgtgcggacggccaaacggaccagtgacaaggggccacgggtgattcggcagaacttacgacaaaagggtgtgggcgagcagctgattgatgacgcgctggccgggcagtttagtgctgaagagcagatcgataatgccagtgaacttgcacgtaaactggcaaaacggtatcaccgccaagcttttaagaccatgcaacagaaagttcgccaaggtatgatgacgaagggctttgataatgacacgattacggctgcgattgcgagtttggcattagaacccgacgaagatgaacagtgggaagccctcgttgcacagggggcgaagttgtggcaacgcaatcgcaagtatgcgtttcgtgaacgcatgatgcgcacgaaacgcagcctgttccaaaagggcttcatgatggacgatatcaatcgatttatcgacgaacaagttgctgatgaatgaaaaggttgaattacctgcccgcacgccataaaaatctggtataatgtttaatgaaattcgatgaaaatttaccctcattttagaaagttgggttaatatggcgcgcgaggctaagggacctaaggaaggcgacttcattacgatcaaaagctataagcacgacggaagtttacatcgaacttggcgcgatacaatggtactcaaaacaagcgagaacgtactaattggttgtaacgatcacacactagtcaccgaggatgatggtcgccggtgggtgacgcgggaacctgcaatcgtttattttcataagcattattggtttaatatcgtggcgatgattcgcgataacggcgtttcatactattgcaacttagcatcaccatacgtgttagataaagaggctttgaagtacatcgactatgatttggatgtcaaagtctttcccgatggtgagcggcggttgttggatgttgatgagtacgaagaacacggtgcccaatggcgttattcggctgatactgatcgcattttaaaagcaaatgtgaaagtcttagttgattggatcaaaaacaaaaaaggcccgttttcacaagactacattgatatctggtatagtcgctatcaagaattatcacgtcggcaatagctctgctgacggtctgtcagcggcgtaattaaagtacaaagggagtgactccgtgctggggtgctcccttttgtgttctggttgcgtctcgacattgaataataagagatgattaccagccgtcatggttgacacaagtcatgataattaggacaataaaaagcggcccacaagtcgcctctgtgggtcgggtgaaaataggaattacacttttaagcgccaaagttgactggccgcgaatagccaaccgcgtgccaccacggaacgtagactttttcatttttgacaccattgtcctgagcgtcaatcatctttccaccaccaacataaataccgacgtgtgatatcgaacctgtgccactaccaaagaagactaaatcgcctttttgggcgcgctgtttggaaattttgggatattgtcggtactgagcttgggccacacgtggtaaggttttctgcgcagcttgctggaagacatacttagtgtaaccggaacagtcgaacgtgttcggaccgaccgcaccatagacatagcgatggccaagttttgatttggccacgttatagaggttggtgaaagatctggtgctcttcttgagggagccggtcttgacccagccacgaacacgggtattagcactcgttataaaataataattagccgtggtattattagctaaacgaatttgccgttgttgggtgacaaaccaagtggtattaccatattgtcgaagcgttccccgactctggattttaagattatttgcggcaccactcatgttatagaagccgccctgagtattcttcgtcaggtaggcgcttttagtaagattagtggttttaatgacgcgattcgttgagctggcatcgacgtttggtgcttgccaaagctccaccgtgaggcctaaaatagcaacaatcagtgtgataagacgttgtttcatatgtatttcctccccgaaaatccccatgtccatctcattcaataacgctgaccccatcataagcgctcattgtaacaaagttgttgcaaatgagttgcggttcgattaagtaatgtctacagcttgagtggattaacaataattgattagatcttgaccgataggagtgacgaacttggcttttttgaagattgataacggtgaattacttaagaatattcggcaatttgccaagaagaatggattgaccttagcggaagtagcgaccttagcaggcttaagtgcgagtgccatctatagttggaaaaagcacacgccgtcagtcggtacgcttaaggaagttgctcaagtgctcggtacgagttataccaaattggttggtaaggataaagaaccgacagctaaggcgaccaatgccgctgctgttgatcttaaaaaagtgattgaaaacaagaaaaaccagtttgaatacgacggccagccgattactaatgaacagatgaaaattatcagaaacgtcttgaagtcgatgtttaagaccccgcgactttaattttaagtaaaactcggttcttttaggtgcaactgggacctgcttagtgtaaaatattgctcagttacttgaataattgctagcagcgcttgacgggtttgaatgaatggtgcacaatggcaacaattatggaacggattgggagatgggcgtatgaaaaaagttactaccgcattagcaaaaaagaatatcaaccagttgttaacgattgttaatcaaggccacgataccattgaggtggaaaatcccagtacccaagattcagcggtaatggttagtatgaaagactggttgcagattgtcagccaattagccaaaacgaatcatcatgacatggaattcagttaaataataacaaagaactaatcgtgccagtcaaggttcgcttagtccaataagctaaaggcaccaccgacataatcatgtcggtggtgcctttttgaaagtcgtagtatttataataatgcggattgcgctaaaattttctcaatttgaacgccgactgtgttcatggtcgcccattttgcctggttggcaaagaaaaccatggcaattttactgtcgttggagccgatatagaggctatataaactgttgtcggcaccaccaatgcgaattgtcccatcatcacggtagtagattccgccagaataggtgggttgtaagttggcggccagttctctgaatccagccgaagtgagcaaatgaccatcgaccagattatgaatgaaggtgtaaaagtcacccacactggcatagaggttgccacaaccaagctcgcttgacagtaagttagtcgaaattgaccggggagttgaggcccctttactgaaggtgtatgggagcggatgaacagcggtggctggtacttggttataaacgaacgtgtgctgcatgttgagtggctgcaaaatatcagtttcgaggttggcactaaacgattggcccgttaattggtcaacgatacctgctaagagggtgaaggtggcgttggaatatgaccactggtgttggttagtagacgtcaaatgttgcaatgtgaagtcgatggcttgttgatcagtgctcaaggcctgatctgggacaggttcacccatctgaatccccgaagtatggtcgagtaattggcgaatcgtaatcgactgtgcatagggtacttgcgggtaaaaatgagccaacgttgtgttcattgtcaattttccagtattgatcaaatgctgaataactgcaccagtcactgatttttctaatgaggctagtgggtacgactcgtcaacggtattggctaggtgttgattcaaatcagctgagccaaaagtcaaagttttgactcccgctggtccgttgttagtcaggagcagggtgcccatgaaatgattagtggtcatgagctgattgacggcttgtaatgcttgctgagccgtgtatttcgtgacgggtgcggtattgactgacatcgcaccggaggtacccgttgcagtcgacgtgctcgatgtcgcggctgtggccgcttgtggtgcggtcgctgacattgtagtatggctggcagtttgtgcggcgccaacctgactagcgccggatgttccggttaaagtcgctgcacttgatgtccgggttgcgactgtctctggtgtggccgctgacgttgtggtgtgactggcagcttgtgtggcactgttctgactaacaactgacgttcccgttgcagtcggcgtacttgatgtcacagcgaccgcttgtggtatagctgctgatgtcacagttttgtggtcagtttgtgcggaagtggcctgactaacttgtactgacgcgctgttcctaattggcacctgacttgcagggcttacgctggtactaggctgatttgctagtcgcgcagcggttgcaacctggttagtgtggatctgctgatacctaagcgccgtttccgctgtggttgccgtttgagttgtggtggctatggaagcggtattggccggagtagctaccgaactgactggaacttgatgggtctgtgccgtggcagtacttggatgtaaccgaatcgtcgcgtgtggttgggttattgctggtccttgaacggtttgatgatcgttcaacttagctaatggtttgactggtgttcccatagaatgatttccctgaggcgttgaagtggatttctggttcggtggtgtaactggtgttggtgcattcacatgttggggatgtccggctgggctgttggggtgcgctagtgctgggttgttctcggcgtgtcgaaatttaacagtgttgttaagattctggggctgtcccgtagtagtcgtgcctgacttggacgttgttagagtgttcccagccttggcgtgaaagggcataactgttctggttggggtgattaaatgttgactttggtgcgaagtaggcagtgtgaatcttaatggcatcttgttgactgaaacccggatatgccgaccctgtggtcctaggatttgaatgtattgcccacacgtagatgaagctgattcatttgacgcgtacttaattgatgagtcatgatcagttgcagctgccggttggttaaaattggcagcgtcgtggtgtggatactcaattttgctgcccggttgacgggtgttttaaattgttgtcttgtcaaatgcttaatgagcggtattactgtgcgtgcggcgacccaaccattaaaacgattgccgatgatgtgaaagtaaaatccaccaaggccacgatgctgctgagtgattttgaaagccgtgtttatgggttggcgggtgaagtagccgcgccgtaattggtgttgattagttggcaattgcggatagattgtgactccgtggctggtacgtagacgaccgtcaactggtctagttgtggcggtggccggttgagcaagtgccagactactgaagctgatcaaggtcagcatggtggttgcggataacctttttttgaacgtcaaattaattcccccttttagctgctcattaatataaaacggtaatccgacaattgcacggtttttcgaatcggcgttaaacttcctaacatggtttggcaagatacggtgttttttaagttaacgttgttttgacagagtaaataaataaaaaacggttaatacgttgtatacgtattaaccggttagcataatgattgttagttcgttgacatttgagtgctgattagtcggtctgactttcagcgtacttggttttgatataatcagctgaaacttgtaattttttcaattcttcgtctgtgagatccaattgaacttgttcgacgatcccgtcacgaccaacgacggctggatatgaaaggtatacgccatattcttcccggaaatttgaaacggggagttcggtgagggcgtcattcaagaccgtgttggctaagcgcaccgcggccgttgccacgccataactcgtatattttttgccatggaagacccggaagccaccgtcgcgtgattcggcgtctagtttggtcaaatctaaaccgcggtcagcggctaatttggtaattggttgacctaacacgcgtaccgttgaccaagctgtaaattgggaattgccgtgttcacccaggttgtagccggccacggaccgtgaatccaggtctagtgcactggcgaccgctcgtttcattcgtgcagagtccagtagtgttcctgtcccaatcacgtaattctttggcaacccggtaaccgcttggtagatcgatgtgatgacgtccacgggattagtaatgacgactagaattccgttgaaaccactggctttgattttagcagcgacgtctttgacttgtgtgctggtaaagggtaattctaggaagcggtcattagttggtgaatcttgtaacttaatattcccgatagctgagataatgacatcggcatcaatgaggctgctatagtcattgataatgatattcgtgtgataaggtaaattaggcattgcatcctgaaaatcaagcgcgtctgcttcaactttgctggtgttcgtatcgatgaggacaaggtcatcggcaaagccattggcgacgatgtagtgagcggcggttgaaccgacgtgtcccattccgataatggcaattttacgtgacataatgtagcgctcctttgaaagtttatcgttcattaattaaattaccatcattctcattgattttaaatagattttgtgagaaatatcgaaatcgtattcggactaagtgaaatagggtataattaacgcattaatagttgcaccaagaaagggaggagcgcgagtgtttaagcgcctaaaagattcggccttgttattttggtcacttgaaattttgattgtggcgaccttgatctgggtctgcacgaacattggttttttgtttcagccaatcggcacgtttttaagtgtcgtgttcatgccaattttgatttcaggatttttattttatatgttgaatcccttggtcaagttgttgactaaggttcattacaagaagtttcggatttctcgaaccggagctgtggctatcgtatttgtgctattattcgggttactggtgtggggagcggtttccctgttgccacggttagtcagtcaggtgacacaactgatttataacctaccaagtattgccactgagatgcaaaaagccgctactaagctgatcaataatagttcggtactgaaaagaattgatattagctcgtacaccaagcaattcaatggtgaaatcagtaagtattctcagaactttttgtcatcattatcaagtagtgttgttacggtgatttccacgattacgagtgtgacgatcatggcaattacgattccagtcgtattgttctatatgttgaaggatagtgagaaattcattccagctatcagtcggttcttaccgaagaaacagtggcctgaagtcattggtttactacaaaagatgggcgacacgatttctagttatatcagtggtcaggttattgagtgtctcttcgtggggacgtttacggcgattggctacatgttgatctcgcaaccatacgggttattgcttggcgtgattgctggattgacaaacattattccgtacgtaggaccttacattgggatcgcgccatcactcatcgtggccttcaccaagtcaccgatgcaggtagtgtacgtgattatcgtagtcgtgattgttcaacaggttgatgggaacttaatctatcccaacattattgggcggacactcaaaatccacccgttaacgatcattattttattactagcagcgggaaatattgccggaattcttggcatgattttagcgattccgttctatgctgtggtccggaccgtggttatttacctctataatattgtcgagttacgaaatgaggagcacttgcgtaagcaaacgacggtctatcagccgcaacctgctaaggcgactaaagcagacttgacgacgaccactaaatcaaaaaagtagtctgtgctataattggtgaattaagcttgaacgtggcataaggagtgattttttgaagaaagtaattacgtatgggacattcgatttgttgcataaaggccatattcggttgcttaagcgtgcacgggccttgggcgatcatttgaccgtttgcgtctcgaccgacgaattcaatgctgagaagggtaagcatgcgtacacctcgtatgaggatcgtaagtatattttgcaagccattcgctatgtcgatgaagtgttacctgagaaaagctgggatcaaaaaatccgggatgtcgttgataacgatattgatattttcgtgatgggtgacgattggcgcggcaagtttgattttctaaaagactactgcgaggtggtctatttgccccgtactgaaggcatctcatcgacgcgtatcaagcacgatttagggatgcaatccaaggattaaccactaagctagatgatttatcagtcacaaaacaccgctgttacccgcaacttcaagctgcgtaacagcggtgttttaattaacagttattagtaagtcacgcctaaatgaccatggactggttcgatgcggattatagttagcattcagccagttcaaagggcttaatggaagatggcgttgagcgccaacacgcctccgagaccgcagacagcgatgatcgtttctaacatcgtccatgtaagcagcgtttgcttgacggtcaggtcgaagtattcccggaacatccagaaaccagcgtcgttcacgtgagaagcggcgacactcccagagccgatggcaattaccatcagggcggggtcgataccagcttgcgtcattaacggcgcaactaggccggctgccgtgagggccgctacggtagcggagccgagtgagacccgtaagatgacagcgactagccagccaagaatcagtggtgagatgctgctgccactgaacaactgggccacggccttaccaacacccccatcaattaagatctgtttgaaggcgccacccccaccgatgattagtaataacatggcaattgacttagtggcatcttcgatggtggccgtgatggccttattggtcttgtgttggtgaatccccattgaccagagggcgaataatagtgaaattaacatggcaattccgggtgccccaatcaaacgaatgatttggtcaagggtcgacgggtttttaggtgtcacaccgtgatcaacgactaattcgtagacggtggtgattgtcatcagaatcacggggaagagcgccgttaagacactgagtccaaacccgggtgcttcagatactttgaattgacgtttgttactgctaagtggcaggtgtggtttaccggtgaatgcgtcaggaaccatcttttgcgcccagcgtgaaaagagcggtcctgcgatataaacagttggaatcgcaataatgatcccgaatagtagcacatgacccacgttcgcatttagcgtcgtcgcaattgcagttggtgccgggtgcggtggtaagaatccgtgagtaacagataatgcggcgcccatgggaatccccagatagagaacgggaacttgtgcttcgatcgcaatggcaaagacgattggaatcaacaagacgatcccaacttcgaagaagagggcaatcccgatgataaatgaggcgactacgatggcaatttgtagccgtttgcgcccaaaaatatccaatagtgtcgtggaaatcgtgtaagcaccaccagcatcggccactaagcggccgagcatggcaccgaagccgaagactagtgctaactcacccagttgactgccaatcccgttctgaatactagtagcaatcttagttaatggcatccctagtccgattccgacgacgacggccgtaacaatcagtgcaatataggtattcagcttgaatttaataattaatagtaatagtagtaggatgccgagtgtaagaacaacaaatggcatagtggacactcctaacgatttagagtagcaatttcgtgatataacggtgccaattgcgccgttacgtggtcaaaaacgacttggtgttgatgatataactggtggttggcggcgttgggttgataagtttcggttgcaccaatcatggcgtgaatcgcggttaaatcatcaatatgccccagtgccttgagtccaatcacggccgctgctagacaggaactttcgaagctcgctggaatcgtaatgggttgtcccaatacgtcagtcaaaatttgccgccataaacttgaacgggcaaagccaccagtggcccgaatcgcatgaactggttcggcggctgccgtcaattgtaggacagtattcaggttcatcacgataccctctaagaccgcacgtgcaatatcggctttggtcgtggtcgtggtgacgcccagcagtgaaccgcgggcatccgcattccagagaggcgcgcgttcaccacttaagtaggggtgaaataagagtccgtgggcaccgacgggaacggttgcggcaagcgctgtcaattggtcgtatggatcttgttgattcgcacgggcggtttggctttcagtagtgaagagctcatcgcggacccaccggaagacttgaccaccgttattgatcggcccaccaacaatccagtggtgcggcgcgacgtagtaacaaaatagtcgaccttcaggatccaagtatggttgtttcgtcatcacccgtacagcaccggaagtgccaatcgtaatggccgcaactcctggttcatcagcccccacccccaagtttgaaagggcaccgtcacttgcacccatgataattttcgttgtgggtgcgagtcccagggttgatgctgcgactggtgtcagtccatcgatcacggcgtcggtatcgaccaatggtggtagctgcgtgcgggtgatgtgtgcatagtcgagcgcgacaggttcccaatcgaagttataaagattgaataggccagtggcgttggccattgaataatccatttgaagttggcccgtcattttgtaaatcaagtattctttaattccgactacgtgacaggtttgtgctagtaattccggtgaatgatgggcaagccagtgaagcttaaccaggggactcatcgggtgaatcggcgttcccgtaaggtgatataggcgatcgcccaggggttgacttttcaattcagcggcgtcttgtgcggcccggttatctgcccaagtgatgacccgggtcagcggttgtttctgactgtcaagtaggatcaagctgtgcattgcggatgaaaaggcgattccttcgatgtcttcgggatcaatgccagcacttacttgatggatggtcgcttggactgcctgccagatttcttgcgggtcctcttcggccgtggtcacggtatcatgatagagtgggtagccaacgttggcactcgcaattacgtgaccctggtggtcgtacaagacggatttggtacttgtcgttcctaaatcagttccaataaggtaagtcatggtgcttcgttcctcctattcgtgatcgacagcgtggccaccaaactcgttacgtagggcggcaacaactttaccagtgaatgtgtcatcggtttctgaacggtagcgcatcatcaaggccatcgcaatgaccggggtggcgacttgttggtctagggccgtgtctaaggtccagcgaccttcaccggatgaatgcataacacccttgatgtcatctagattaccatccttgctgaatgcatcttgagctaagcccattaaccagctgcgaatgactgagccgttattccacattttggcgacggccgcgttgtcgtaagtgaactgactatgctgtaaaacgtcaaagccttcacctattgctgccatcataccatactcaattccgttgtggaccatcttcaggtaatgaccactgccaacagggccggtgtacaaatacccatcgggagcggcaatcgctttaaatagtggttcgacgacttggaaagtggcgaggtcgccaccaatcataaaattgccgtcgtggcgtgcaccagcttgaccgcccgacgtcccgacgtctaagaagttgatgtggtgacttgccagtaattcgccgtggcggatactatcttgatagtgcgaattaccgccatcgaggacgatgtcacctgcacttaaagtctgggctaactgttcgataacgctgttggttgccttaccagcgggtaccatgatccacacgatccgtggtgttggcaactggtcaagcaaattggtgagatccgtggccgtcgccaacccgtgagcactggcggtactaagattagtggggttaagatccattcccactggcgtgtgcccgttatcctgcatgttcaacgctaagttcattcccattttacctaagccaatcaatcctaatttcatgatgaaacccctcttttatatgaaaaatattaagtactttttgtattcgcttacattgtaataaaactatttacataaatcaaccatatatttgtaaattattttcattagactgaaaataatggcaaccaagcccggttttacaggcctgattgccaagaaaaaatttgttaaattgctgaccaaacggctgcgccgatacttgggaagagggtcacgagttgttcacgttgcgccggtgtcaattgatattggatcgctggtagcaacgtgttaatggtattttcggcctgttcaccgagttcagctgcaccaatcaaccggtgctggtcatccgtcacgagtaagttatggccggtgacatcgcgcgttgtctgccggaaccagtcatcctttaaatcattgacggtaactttgatatcatgagtgtcactggttggaagtgtaccaacttgggccaatcgtggggacgtgaagacgaccgatggaatggccggatacttgatgggggcattggtgtcacccatgaataggtgggtcaggtattgcgactcaaagatagcagtgggtgttaattttggttgatccttggcgagaacgtcaccggatgcgtagatgccagcgacactcgtttgcaagtggtcatcgacggtgattcccgctgctgtgtagtccacaccgattttttcaagtcctaagtttgcggtgtttggctggcggcccgtcgcatctaagatccagtccgttgtaaccttgtcatccgcactgaggacttcgaagtggtcaccagtcgacttgatcgcagttggcacccattcacgttttaggactaaaccttgttccacgagaatggccaataatcgttcaacgaatggttggtggaattgacgaagcgcttgatcaccacgcatgagtagggtgacctgactgccggctgttagtgccatgttggcgaattcgagtccgatgtagccggcaccaatcacggtgatgtggtgtggcaaagtggttagattcaaaaagtcgttactgtcatgggcgagttcggttccgggaatgtccaaacgatgtggatgctgacctgttgcgatgacaattttatcggcggtgtacgtcttgtccgccacctgaatcgtatggtcgtcgacgaacgttccgcggccattgatgagggtcacgccggcactagtcattaagccagcaatcatatctggtaagccggcgatgacgtcgcgttcgtggtcgaagttggcttgccaatcaatcgtcggttcaccacgcagaccgtatccttggaagttagcaacttgattttttaatgctaccggctggtctaaggtgattttagcgttgcaaccccgattaggacaggtaccaccaatcaaatcagcttcaatgacggctacttttttgccacgagccgctaacggaatggccccgtcaaacgttccgtgaccgctacctagatatacaacgtcaaatttttctgacatattaaaatcctcctcgttcccaaatcacagttatttaaaaacaaatacattgtacacaacttaatttaacatgccaaataaaacgcggccttaatttaaaagtatagccctgaaatcgattgcaactggtctgtcatgactttgttaagtgaattcccaccgaatcggtgcaagatagtcggtggtactggattttttggtcaaatatcagtaaaatatgtaaggctatgtttttttacggtgggacggtaccaccgtgcacgttgaatatacaggttatgatgaaaggaatttttaatgaataagacagaattaaccgccgcggtcaatacccggcgtacctttgcgattatttctcacccggatgccgggaaaaccaccattacggaacaaatgttattgtttggtggcgttgttcgtcaggccggaacggttaaagcccgtaaaagtgggaactttgccaagtctgactggatggaaattgaaaagaagcggggaatctcagtaacgagttccgtgatgcaattcgattacgatggcaaacggatcaacatcttggacacgcccggacatgaggatttctcggaagacacttatcggactttgatggcggtcgattccgctgtcatggtcattgactcggctaaggggatcgaaccacaaacgaagaagttattccaaatttgtaagatgcggggcattccgatctttacgttcatgaacaagttggaccgtgatggtcgcgaaccattggacttgttgaacgaagtcgaagaagtcctcggaatcgaaacttatccaatgaactggccaatgggtatgggtaagggcttaaagggcttatacgatcgttacaatcaccgtgtggaactttatcataatgaagctcatggcgaaacgttcttaccactagacgagaacggtgagcttgatcctagtaatgaattgaccaaggacagtatttatcgtgacacgttggatgaagtcgaattgatcaacgaagctggtaatgattttgacgaagctaaagtaatggcgggagacatgacgccagtattttttgggtccgccctcaccaatttcggggtcgaaacgttcttgaagacgtatctgcagtatgcgcctaaacccgctgctcataagactcgtgatgaccaagtcgttcagccaaccgacgatgaatttgccggttttgtgttcaagatccaagccaacatgaacccgaaccatcgtgaccggatcgcttttgtccgcatttgttctggtgaatttgaccgggggatggacgtggtcttgcagcggactggtaagaagatgcgcttaaacaactctacgcaattcatggccgatacccgtgaaacggtggaaactgccgttgctggcgatatcgtcggcctctacgacacaggtaacttccaaattggagatacgatttatgctggcaaaaatgcggttcaattcgaaaagttaccgcaatttacgccggagctcttcatgcgcgttacagccaagaacgtcatgaaacagaagtctttccataaaggtattgaacaactggttcaagaaggtgccgttcagttgtacacttcatattcaacgggtgactatattctcggtgcagtcggtcaacttcaatttgaagtcttcaaattccggatgcaaaatgaatataattcggaagttgtcatggaaccaatgggtagcaagactgcccgctggatcgatcccgaacaattggatgaaaagatgtctagttcgcggaatctattggtcaaggaccgctacggggcaccgctcttcttattcgaaaatgcttttgccgaacgctggtttgcggataagtatccggatgtcaagctgacctcgaagctctaggatttatattgtggtttacacttagctgaccaatctagttagattactgttcgtcagtcgatgtgcgtcctatttcgacctccggggctgggtgacaattgctggaacgtaagccgacatcgatttgagctaacgcacaatccacggccacttaacttggtgcaattggtcgctaactattttgatactggaactttgaataaaacatcagggtgcataaacgactttgtcgcacattcaattttgaccacagcggcttaagatagtgagctattccaatatcattttcagtctgatagttgcttagcaaaattacagtttatgaaaggcaacgacaaattcatcaaaagttaggtacatcttcgtctgccattcgaatactttcccgactggaaggcgtttctgccaatgctcagcggtgaaattccacttagcaaacgttttttgcttggttagtggaagaccagtatttaagacgtggtcttcggcttaaatctgtatccaccgcgttccagcaattggcagaaatgcctggaagtcagcataggacgcactaactaagcaagtttacgctaactcgaactttttccagcggtcctaagctggtcgctcttgatttaacggatagaagcaaaagcacgaacaaatatgcgaataattcataaaatgatggggctgccaagttgatttggcggtgccatcattttttgtgtggcgggaccggatagaagtgatatgagaggttcttctaacatgcttatcggtccatgtaaattcaccatgtaaaccaacgttgtagcactgctaaggtgagagaattacgatacaatcaatctgcaatttagattgtagggggcgatgagattgaaaataaggggacgctggatgctgggattgatgttaggaatggggttgtggggcccggtgacggtgcacgcggcgacgaacttggtacggtggccagcggtgcaaagcttagcgccccggaattgtgaacttgaatcgaaacaaacgcgcttatatcaattaaatcgtgcaacgatgcaattaacgccacgtgggacggcccggacgactagtcactggcaacgggttggtcaggtgatggtgacacaaaacaagcggttagtgacttattggcaggtgcgtcacgggactgctgggcgactgagttgggcgttggcggacaccgtacgagttgtcggaaccagggtcactgatattaagacgcccacgcggcaaccgatgcgcgtggtgacaacggatcaacaggaacacggggtgacgcgcgcggccaataagctgagttatttacccttaaaaggggcgggacggtacaccactgagcatattttgtttcgtcctaccgccgcgtatctagcgactcaggggctacaaaatcagccagacacgttgcgccagagtagtggctatcgcgaccattatcatttcaaaacagcactgtatttaccgcaacagttagggagccgcttgttgaatgacccacagagtgtgacgttttcagctgacaatcggtacttgtacgtcatgtacgtcaatgatcaacagttgggtggcgccgaccagactggctgggtcgttcgctatgattggcaacgcctgatggctttaggggctgggcaatcagggaagatggcgatggtccgagtagcagcagctcaccaattcgacgggaagatgacggcttttgaccgtcgggtgctggccgccattgaagtggggccggagtttacggcgggacacgttcagtcactagctttaaatcctaagacgaacgagctgtggtttatttcatcgacggcacgtgatcagcttgcaagtgttgcgcgactaaatccgcaatccctgacgccggatcttaaaattgcctttactactggtagcgggcgtctaggtgatgaactgacttttgatcgcgctgggcaggcctattattggacgcatgcgagtcagctcagaaatggcaatgtcacgctttatcgtggcacaatcagttcgacgactggtgtacattttgaacaactcgcgcaggggttagctaataattcgggtttcttcgcccaatcgattggatataacgaggttactggtcggctctacctggtctccgatgagagtattacgtcacttccagcggctaaactgggacacttgacgactagtcaggtcggtgaggcgaactttgctggtgatcgcgagtttgaagggttagtcttcatgcgccacagccaggaaggtttcttgctgacgaatcggggcatcgagttgatgcgcataattgttgataagtagatattaaaatgcaccactcgctagattagattgaagctagcgagtggcgcattttagcatggttcgcgttaatcgaacaaaagtcttgtttaagcaaacggtggatctaatttcgttaaataacggcccggcaagtaaccttgatcttgcaggcgataccagacgaccccgttgtcgtcggccattcgctcaatcaaattgaccgtgtcaccatgagtgacggtagttaaatagcggccatatggttcgatgtatgtgtggacctgtttgccagggacaaaactgacgacgccggtttggcgaacaggccgtttattttggacgcggtagccggctggcaacttgagtaacagtgtgtcaccggtagttaattggaggtgcgtctccggaatccactgatcatcgccaatcgcataccaggtctcgtgggtgactaagcgaacgcgcatgtacgttttataagtgctaccgggctggagcgtagttaaatagttggtcgtagttgccccaggatacggataaacggcggtcaacttgttgatttggacaaaaccagtactgaggtcagtttgctgccaattttgattacggtagaaaaaaaggaccgtcttggaagtggtcgtgtattccccagtcacgtcgcctacggaacggaggagcttaaaaccggcgacggtcggcgcactgacttcgtaaggggttcctaatttcccccggtacatggtcggccggccaattagttcgcggcggtcaatgtcataggcgtacatccagactggttggccagcttggcgttcgtaagtcaacgtgatgctagcctgtggggtcgtaaaccagcgggtcaagccttcgatatggacgaggtgataaccggtgatgctgacggcaggcaagtgaatctcttcgccaatggtgccagcaatcatatcagcagcctgcagttcattgccatcctgatctaggtggtgaacgagaactaatgcttctgtttggttaactgcaggtgctgcggcagtttgtgcggcaatggaacgtggtgcctcagtagcgcttgtggcggctcccgtgctgtttagtgcctgaagcattcctttaagtcggtcaagaaatgacacgtgaccactcctttcattaataaattaattatcactagtataacgcattcacaagggttctggcacgtcttaaataaattgtaaaattcccgctttgtcagtcgtgtatactaatatttaataacagggggcgttaacggatgaatctaaaacaattacaatattttttggccgtggcagaggaaggtcagatgacagcggccgccaaacgcttgcacgtggcgcagccaccactgagctatcagattaagcaattagaacttgaactaggcgtcaccctcttcaatcgcttgcctcagggtgtgactgttactgaagctggcaagctactggtggggtatgcccaacagctcacgcagttgtcggcgactgcggagaacaaggtccgggccctggcacacggcgtgacggggaccattaatctggggacagtttcatcctcggcaggggtcatgccgaatacggcattactaaagtggttagggcaacatcccgatgttcagcttgcgattacggaaggcaatacgtatgagttgttagacgatctgcataaacggttgctagacgtggcggtgttacgaacaccgttcaacgcgcaacatctagtctgtcgttactttcccgcagaacggatggcagcagtcattccgaagcgatattcacggtttgaaaagcggcgccagttacaactaagtgaccttgctacgttaccattgatcaagtaccgtcggtttaatgaattattccacgttgcctttctggaagcgtcggttacgccgacttacatcatgacttgtgatgatgcccgcacggcgatgcactgggctaatcaccaattgggagtggccctggtgccacggtcattggctgaaacctatgacggtggtgacgtgctgattcgatcattggcggatcatcgttttcagactcaactggccctagcaacgaccccggaagccttagcgaccccattagttgccggtttgatggcacaattccagcaagcgcagtcgctagactagtttaatcagtttgatatctaaaaatttaatcgcgattaagggtggattgctgatttaatcgggttgttaccgattacactagctagaaattgaagtggtgttttcagacgcaaaataagcctaatgactgtcgtactggggatacgctaaccttcatttaataattagatatcaatcggtttaaacggtacactaacaattgaaatttaaagggtgaaggtgaaggaaatgatttattcgttagggctaatgctcggcgttggggtaattgccggaattttcggtgctattttaggtatcggtggtggcatgatcgtcacaccaatcctgacacttggtttgggattagatattaagtatgcgattggggccagtattatcgccgtgattgccacgagttcgggctctaccattgcatatttacgtgatgagatgttgaacttacgcgtcgcgatgtttcttgaaattgcgacgacggtcggggccgtcctcggggcagtgttgacgggggtgcttaatgcaacattcctgtacttcctatttggggcgctgttagttttcacgacgtataatatgattcgtaaattaatgagtaagaacggtgaattaccgtcagtcaaagatgacaagctggcgacacagttgaacttaaatggtacttattatgataaagcattgaataagcaagttgattatcaggttgaaaacgtgccgggtggtttttccatgatgttcggtgctggtttcgccagtggcttgttggggatcgggagtggcgcgttcaaagtgctagccatggatacgattatgcatatgccgcttaaaccgtcatcagcaacttctaacctgatgatgggggtgacggcggcagcgagtgcgatggtctacttctttaatgggtcaatcaaacccggaatcgcggccccattagctatcgggattatcgtcggtgccttaatcggctcacgaatcatgacgcggctcaagccacgcttgattcgcatgatctttgtgcccgtgatgctctatctgggaattcaaatgattgctaaaggattcggggtgaccatctaatggataagcaaaaaacaactaaagcgcaagagatgcacgccgttgaaatgatgattgggtatattctacgaattggcgtcattgtttctgcaatcgtgattattattgggatgcttctgatgttgattcagggcaatggtggttatgcaaatggtatggaaccccatacggtcgctgatattctagccggcattgtggcacttaaaccatatgccgtgattatgttaggtttatttctattgattttaacgccaactttgcgggttgcggtctctatctacgcctttgcagtggaaaaagaccacttatatgtttggattacgacgattgttctcatcatcttgattgttgcttcggtgattgggtatctcggtaactaggctagacggagctgattaatcaggttgagtcgtgattaaaatgggcgcacatctaaaatggctaccagcttgtttcgaggttaatgtggaaagaatctaagttggtgtaaattcacgggctggtgtgttttatgccgatgtacgagtacttaactagccaatattgtttaataataagagaatgctgataaaaaatcagcattcttttttatttgtgcacttttagctgttttgactaacgtaaaaaagacctaatatcgtcatttttatcgttatttgaattatttattaagaaaaattggcgattgtgttcacttgataattgaacactgatgtgagaatataattgcttatatatcagtaatttcaggcatgtttatcagtatggataataatcgcaaaatgaaataattaagacgattatgacgaaataatgataaaaattagagtttgggattgattttaatttatttataatatacaattactttaacttttcgagggaaaagcacacacaaactattttaaagttaggggttgggttatatgaatttcaaaacagctgcaaaagtaaccgtcgttgccggcgcatccgtactattcttagctgcttgtggctcaagcaagagttcttcaagttctaagcaaacggccaattggaccgaatcagccgaattaccaacgatggacatttctaagtccaccgatgtggttagttctaacgcgttgaataacactaatgaagggttataccgtctcggtaagaacgggaaggtcacacccggaattgcgaaatccactaaggttactaatggtgggaagacatatacgttcactttacggaagaacgcaaaatggagtaacggggataaagttactgccaaagactttgtttatggttggcaacggaccgttaatccaaagactgcgtcacaatacgcatacttatattcagggattaagaacgctgacgctatcgtcaatggcaagaagcccgtttctagtttaggaatcaaggctgatggtgattacaagttgacggtcactttggataagccaattgcttactttgacaagctgatgggctttgtcaacttcttcccacaaaatgaaaaagtggttaagaagtacggttctaagtatgggacgagcagtaaggccatggtttataacggcccttacaagatgactggttggactgggacaaacttgtcatggaccttgaagaagaataacgattattgggataagaaagctgttaagatggacagcatcaagtaccaagtcgttaaggatccttcaactggcttgaacttatttaattccaataagctcgactttacgacactttccaacgaacaagttaagaattataagaatgataagaactacttagttcggaagacggcttcaactttctacgttgaatttaatcgtaaggatagcgataagactttagccaaagctttccagaacaagaagattcgtcaggccttgtcattagcaattaaccggaagtcctacgttaataatacgttaggtaacggttcgaccgtttctaaaggttacgtttctgaagacttagctaaaaacccgacaactggtaaggactttacgactgacgctgccgttccttctgcagttgactacaacttaacgaaagctaagaagttgtggaaagaagggatgaaagaaattggtgaaactaagctgaacatcaagcttctttctgacgatactgatggtggtaagaagtctactgaatttattcaaggtgcttgggagaaattacctggtctgaccgttactaaccagaacgtcccattcaagacccgtcttcaacggtcacaaaacgggaacttcgatacggttatctctgcctggaatgctgactttaccgacccaatttccttcttgtcactcttcacgtccgacaactcatacaacaatgggaagtatgacagtgccgcatacgacgatgctgtgaagaaggcggaaggtgccgatgccaataacaagactgcacgttgggctgacatggttgctgctgaaaagcaattgatgaatgatcaaggggtcatcccaatctatcaacaagcctcagcaacgttgactcggagcaatctgaagggcatcatctacaacactgcgggctcaaactacaacttcaagtacatgtccgtaaaataatgatgtaaatccacagaaaaaagtgtgtgtgctttaactgaatgaatgtgaagcaaaggggtaaggattgacacattgttaatccttaccattttgttttataatgagggatgtcattattttttaagttgattttaatagaatgcgaggaattctcatgagaaagtatcttttaaagcggatattttacttgttcctgacattattcattgtggcgaccgccacgttcttcttaatgaagttaatgcccggaacaccgctgcaaaatgaagctaaattgacccctagcgaaaaggcgtcgatcttggcccaatacgggttggacaaacctgtttggttgcaatacttcatttacattggcgggatcttcaaggggagcttagggctatccttccagttctctgatcaagccgtcagttacctgattggtagccggatgggaccatcaatgcagttaggtggtcaagcgatggtcgtcggaatcgtctttgggattatcctaggggccgttggggccatcaagaaggatacttgggccgaccgtttagcaaccatcttatcgatcttagggatcgcagttccaagtttcgtgttagccatcctgttacaatactacctcggcttaaaggctggttggttccctgttgctggttgggaaggcttcgcttacacgatcttaccaacgttagctttggccgccagtccgctggccgaaacggctcggtttatccgaaccgacatggtggacgtgctgagttcggattatattgagctagctaaagccaaagggttgtcgaaatttggtatcgtgtatcaccatgcgttgcggaacagtttgattccaatggttacgctgattggaccattggccgccgccttgatgacgggttcaatggttgttgaaaatatcttctcagtacctgggattggggaacaattcgttaaatcaattctggttaacgactacccaaccatcatgggtgtgacgattttctattcagcactcctttgcttactattattgttgaccgatattgtctacggaattattgatccgcggattcgtttaaatggaaatggggactagttaatggcagaaaatccaagtagtatcgatattaagcccggcgacttcgagccgttagataaacaagcgggtcctgataatgaacggatcgcagcaccttccttaacgttcggccaagatgtatggcggcgattgaagtctaacaagaccgcttttatcagctttatcgtgttagtattcttattcttagtggcatttggtggacgggcagtctaccatgttgatcctaatgcacagtcgccacggtatgcgaacctccctccgaagattccgggtgttagtatccatggtttgaatggtcacttgactcaatctggtaaggacgttgatgcgtatgcggcggccggtgcaaagtctgacgtgcattatcttctcgggactgattatctgggccgggacttactggcgcggattatgtatgggacccggatctcacttgaaattgcgttgattgctactttgattgacctgacgattggggtcggattcgggatactctccggttggaaaggtgggcgcgtcgatttattcatgcaacgtgtgattgaaatcctctcgtccatcccacaattggttatcatggtgttgatggccacggccttcacgaagactgggatggcctcaatcattgcggctatcgcgatcactggttggaccacgatggcccggctgactcgagcacagaccttgcaattgaagaatcaagactttattttggctgcacggacactgggtgaatcacccgtcaagattgcttggaaacacttgttaccaaacctttcaagtgtcattattattcaaacgatgttcacgattccaagtgcgatcttcttcgaagcgttcttgagttatatcgggattgggatcagttcaccacaagcttcattggggacgttgatctctgatgggcagaagaacttccaattcttgccatatcagatgtggtacccagccatcgtgctgatcatcttgatgctcgcctttaacttgttaggtgacgggatgcgcgatgcgtttgatccaaagtcaaaacgttaggaggacggcagcactatggaaaaaccagaaaatgtgattgaggtccgcaacttggaaatcaatttccatacttatgcgggcgaagttaaagccatccgtgacgttagctttgatttacgtaagggtgaaaccttggcaattgttggtgaatcagggtctggtaagtcagtgacgacacgttcactgatgggcctgttagcacctaatgctgaaattaaacgtgggagcattatgttccacggtgaagatattattaaaaagtccgaaaaagacatgcaacacattcgtggtaaggatattgccatgatcttccaagacccaatgacatcattggatccaacaatgcggattgggatgcagattgcggaacctttgatgaaacataagggtttgaagaaaaaagaagcgattgcccaagcgctagagatgttgaaattggttgggattactaatcctgaaggccgaatcaatgattatccataccaattctcaggcgggatgcggcaacggattgtgattgcgattgcattggtctgctatcctgaagtcctgattgctgatgaaccaacgactgccttggacgtgacgattcaagcccagattctggacttgatgaaggatttacaaaatcgaattgatacgtcgattatctttatcacccatgacttaggtgtcgtggccggaatggctgatcgggtcgcagtgatgtatgccggtaaaatcgtggaatacgggacagtcgatgagatcttcttcaatccacaacatccttatacctgggggttactcaattcgatgccaaccttggatactgaaagtggctcattatcagcgattccagggaccccaccagatttgttggaaccaccagttggtgacgcctttgcagcgcggagcgattacgcgatgaagattgatacggagaaggaacccccattctttaaggtttctgatacccattacgcggcaacctggttgcttcatccagatgccccaaaggtaacgccacctgctgaaatcgttcggcgtcagcaaaagtttgcggccatgcaaaaaccgcaagcaccaatttcaaatcccgtagcaaaggagtaagtagacatgcctgatgaacgtaaaaaaattctagaagttcgccatttaaagcagtattttaatgtcggcaaaaaagatgaagtccgggccgttgatgacgtctcctttgacatttatgaaggtgaaacatttgggttagttggtgaatctggttcaggaaagaccacgaccggacgttccatcattcacttatatgaaccaactgatggtgaaatcatttttgacggtaaggacgtttccaaattacacactaagaaggaacgccatgaatttcgccgggaaatccaaatgattttccaggacccatacgcctcattgaatccacgaatgaaagtcaaggatatcgtggcggaagggattgatattcacggtttagccaaggatgatgcagaccgaaccaagcaagttgaagacttattggagacggttggtcttaacaaggaccactctagtcgttatccacatgaattttcaggtggtcaacgtcaacggatcgggattgcccgggcgttagcggtagagcctaaattcatcattgctgatgaaccaatttctgcgctggacgtttcgattcaagcccaagtggttaacttgatgaaggaattacaagttaagcagaacttgacttatttatttattgcgcatgatttgtcaatggttaagtatatcagtgaccggatcggcgttatgcattacggtaagattctggaaattgggcctgcggatgaagtgtataatcatccgttacacaagtacaccgagagtttgatctcggcggtgccggtacctgatccagagtttgaacgtaaccgtaagcaggttccttatgacgaaacgaccgaacatgacggtaagaagcggcgaatggtcgaaattgcaccagggcactttgtccgggcaactgaagacgaaatcccgatatacaccaagcgggctgttgacgcggggttaattacggaattttctgagtaacggctaataaaacagacggcgagtgcgaatactcgacgtctgttttattattcagtagaatatttaattaactgtttagataagtttattaattaataaccattataattaactcatattaacttgacatataaatttaatatgtaaaaaatattgatggaatcaattgtcaaaaagccgattaaatcggggatagacggctatttttgaccagctaaactgtgaccggtagtcaaagttatttgtgtaaattttgtaattatgcaataataatattgttaataaagtttgttaacaaatataactattcgtcttaataattgattcgcaccatttttaaaaaatcatgcgaagggacaatggcttgttttgaacggttaatgaaaaaagtacaaatttcaggaaggatgctgttagtatgcaacaaccaattaattatattatgaatatcatgcaccttgaacgggacttaaaacgacttacgtcgaactggtcgtccgccacagggcttagtttgaacgagttacggatcttagtttatgtcgaacaacatcctggtatccagattggtgatgtggcaaatgcgttgaatgtggcgaaagcctcgttggcacaaaatattggcaccttgataacccaaggatggttgaaaagtcaaccaattaaacaagaccggcgtttacgggtcttaacgcttacgaaggctggtcaggatcgaatgaaggatgttgatgcacaattgactaaatcacttgacacgacaccagcaacacagttagcggatcaattatcagccttgcaattataggcagatgtacacgttcacggatattaagtgaagtaatatccttaacgcgggataaaggggagactctttgtcccgcgcttttgttttagcacttaatagtggggagcattataggttaacaattactttgtttagtttactctaggttaagtaatttaaacttaataagattgattgaggtgtaatggagcgtatgcattataatgttgaaccgctacgaacggaccaagaaatcgatgattttttatgggctgtttcacaagcgcgttatggggagcgtaatcgcatgattgttttggttggaattaacacgggattacgaatgagtgttttttttacgactgaaggttgggcaagtacgtggcaaagatcgtgttatgatcatggaacaaaaaacgggcaagaagcgctggttgtttttgaaaaacctcaaaacggaattagcccactttacgcggtatcggggtgcaaatgaaccgttattctgtagtggtcggggcggagctttaaccgttaatggtgtctatcgagtctttcagacggccggtgagtacctggagcgggatgatattggtacgcacacgttgcgcaagacgtttggctatcattattatcaaaagactcgtgacattgccggattgatgatgattttcaatcattccagcgagcaggtgacaaaacgctatattggcattgagcgtgataatttggaacgacaattatgggactttaaattaggtgtttaattatggcagagacgcggtctatttcatagcgactcaatgaagatttgaggtaggcacaaaaaagagccggaagtgtaaacgattgtttacgcttctggctctaaatttaattatcttattcggacttcgtctcagccgccaaaacaatcttgccgtcttcaacttttgcaaccatgttcttaacgtcgccgtggtccaaatagaaatcggcgatgcgatcttcgatttgttcctgaataacacgccggagtgggcgagcccccatctgagggttgtaacctagttcaacgagtttttcctcgacaggttctgtgacgtggacgtgtaagccttggttagctaacataccgttgacgtcttcgatcatcaaaccaacgatcttcatcaagttttccttagataaagcgttgaattgaatgatgtcatcgaaccggtttaagaattctggcttgaagtagtccgtcaaccggctagtgatatcgtgcgtcttgccttcagcagcggcaccaaaaccgacattagcttcactgtcgccagtaccagcgttggaagtcatgatgatgatcgtatccttgaagctgacagtccgaccttgtgagtcggtcagccggccatcatcgaggatttgcaaaaacatgtgcatgacatccggatgagccttttcaacttcgtctagtaagactaggctatatggatgacgacgaacctgttcagttaactgaccggcttcttcatagccaacatagccaggcggtgaaccgatcaacttagccactgaatgtggttccatgtattcactcatgtcaaaccgaatcatggcgtcttgggaaccaaacagttccttagcaagttgtttagctaattcagttttaccaaccccggttgggccaacaaacatgaaggaaccaattggccggccagttccgttcagaccgattcgattacgccggatggcccgggcaactgcttcaaccgcttggtcttgaccaataaccgtactcttaagatcgggtgctaaggtcttcatttgagcctgttccttagcctgcaagtcaccaactggaatacttgtcttttcttcgacaatttgttccatgtccttgactgttacagtggcagtatcgttattaggctggtctgaactttcatcgggcttagctttttctaacttagcaacttgatcgcgatagtaggcggctttttcgtagtcttccttcttcaaggcgtcctgtttctgcttttctgcctcgtcgatcttttcttgaatcgtctttggatcgaccgtcttcaacgtcaagttcttacgtgaaccagcttcatcgagtaaatcgatggccttatcaggtaagaaacgatcttgaatgtaacgatttgacaacttgacggctgccacaatggcatcttgatcgtacttaacgtgatgatagtcttcgtacttcttctgaataccttcgagaatcttgatagattcttccacgctcggttcgttgaccgtgaccggttggaaccggcgggcgagggcggcatccttttcgatgtcgcggtattcgtttaatgtcgtggccccaactaattggaaatcaccacgggcaagggcgggtttcaggacgttcccagcatccataccaccttcagcattaccggcacccatgatttcatggatttcgtcaatgaagaggatgatattcggattgctttgaacttccttcattaattgttgcattcgttgttcaaattgacctcgaataccggtaccttgaacaagggaagccacgtccaaacgaataatttctttatctaacagtttttgtggaacttgaccagaaacgattttctgtgctagtccttccacgaccgccgttttaccaaccccagcttcaccaattaaaacggggttattcttggtccggcgattcaaaatctcgataacccgattaatttcggtatcgcgaccaatcactggatcgattttgccctgtttagcttgcgctgttaagttgaagccgtattggccaaggaggccaccgccgttgttattgccacgacgattgccgccattaggaccagctggctgggtcggtggggtctgttgttgccggtaagcgttattaggattaacgccaccctgcattgcacggaaaatgtcgtcaagaccaccaaaaccgaatggatcttgtgccatatcagcacctccaactccgttatttggttgctgttcctgattctttagcagttgatagcaattttgacaaaggttgatttgtcgccgctgaccgttgacgctcgtatataaatggatcgtcgcttcgttcttatggcaattgtcacaaagcattatgctgtcacacacctttcgcatcagaaatataactaaatcgattaggatcatagttaaaggttcatcggctctttgacctttgttgacctttgactattagtatagcgaatttacggactgttgcaagtgaaaagcctcagggtcaaaactggacgtgcggccgggataattcgcaatggctgattgattcaattatttctgaatagtctggatagtcgcaactcatagcttgtcatgtaaccggattcgttgtatattaattatctggttaggataagtgatgatgtaactgtctgtctatattatagtacaaagcggtttttttgcatgtatcgagcctgaccagttttgatgtttgcagcgcatcgtttttcattggtgaccgtcaacagccagtgagcggcggagaactttgttcgtaaatatcaaaataatgatgcagtaatgtgtcaacctaactttgaggaggcggtaattgtttggcaacggattatacccagttaatggaagcgctgcgtcatggcgaacgcgacagttttaccgtaacgccggatgaatttatggcttttcacgacgcctatatgaagtatgagtatcgtaaacgagtcattggtacggcggacttagatggccgcattgtttaccatttcgagaaggatggtaagacaaccaattaataggcctagcttgaatgaaagggcttgtattttaattggataattgctatcatcattattaagggctcttgagtatacgtgttggcggcaactcgaattgactcggaaccaattttaaatttatttatcttgaaggagatcgaatagttatggaaaagaaagaatttcacgttatcgcagacactggtatccacgcacgtcccgcaactttattggtacaatcagcaagtaagttcaactcagaaattacgttgcaataccaagacaagtccgttaacttaaagtccatcatgggtgttatgtcactcggtgttggtaaagacgctgacgttaccatttctgctgaaggtgccgacgaagccgacgctatcgcagctttaactgaaacgatgaagaaagaaggattatctgaataatggctgaaaaggtactaaaaggaattgcggccagtgatggtgttgcaattgctaaggcctatatgctagttgatccagatttatcattcgaaaagacaacagtttccgatacggatgctgaagttgcacggttacatgacgctttcgatgcttccaaggctgaactaaaggtcattaaagacaaagcggttgaaaacttgggtgaagaagaagcagaagtttttgaagctcatatcaccattttgtctgacccagaaatgctcggacaaattgaaggtaagatcaaggatgataaagtcaatgctgaagaagctttgaaggaagttactgatactttcatttcaatgtttgaagcgatgacggataatgcatatatgcaagaacgagccggtgatattcgcgacgtaacgaagcgggtcttaagccacttgttaggggtaaccttaccaagtccagctttaattgactccgaagtaatcgtggttgcccacgatttaacacctagtgatacagctcaacttgatcgtaagtatgttaagggcttcattactgacattggtggtcggactagtcattcagccatcatgtcacggacgcttgaaattccagcggtcgttggatctgaatctgccacgactgatatcaaagaaggcgatacggtcgtcttggatggtatcaacggtgacgctttagtaaccccaacggatgctgaagttgctgattaccaacaaaaggctaaagactttgttgcgcaaaaggctgaatgggctaagttgaagaacgaggccaccgtttctaaggacggcaagcactttgaattagcttctaacatcgggacacctgacgatatggatggggttttggatgctggctctgaagccattggattattccgttcagaattcttgtacatgaacagttcagaattacctgacgaagatacccaattcgaagcttacaagaaggttgtcgaagggatgaacggcaaacccgttattgttcggaccatggatatcggtggtgacaaggaattaccttacttgccattacctgatgaaatgaacccattcttgggttatcgggctattcggatttccctcgatcgtgatgacatcttccggacccagttacgtgcgttattacgtgcgtcacattacggtcaattacggattatgttcccaatgattgcaacgcttgacgaattccgtaaagccaaagctatctttgaggaagaaaaagccaagttggttgcagctggtacgcctgttgctgacgacatcaagcttggtatcatgattgaaatcccagcggcagctattttagctgaccagtttgctaaggaagtcgacttctttagtattgggactaacgacttgattcaatactcatttgctgctgatcgtggtaacgaacaagtgtcatacttgtatcaaccatacaacccatcgttgttgcgtttgatcaagcatgttattgacgctgctcacgcgaacggccgcttcacgggtatgtgtggtgaagttgctggggatcagattgcggtgccattattgatgggcttaggtttggatgaattctcaatgagttcaacttccgtgcttaagacacgttcattaatgaagaaacttgatactaaggaaatggctaaattagctgataaggcacttaacgagtgtgttactaacgaagaagtcaaagaattagttgaaaagaacgtcttcggtaaataaacaatcaaactaagagcaaatctgtggatttgctctttttttgtgggtaaatgcgggtcattaaccagtttgtactagcaccgggtttagcacgacgggggagtgggctacccgcaccggtatgatgagagctggcacagtacatgacgcgaattgactggacatttaggcattgtgacaattgtccatagttgcgaccgcgctagtcaatgatggacacagggcacattgctactcgctgttgacggtgaagagttggtgtagtggaaacgatgtaatggcggtgttgagtgatgcctagcgattacaattcatcatttcgaattcattttctataggtgtagctggtcagatagattttgtcatgaactcttaatttatattaagattatttgcaactcggatatttaaccaatataatgtctataatataggcattaagtcgaattcgtgatgatcatgaaataatgatctaagcgcggttaagcaacatcgattagcagcacagttaattgatggaaataaggggagaatctacgtgaatatcgggatatttacagacacatactatccacaagtgagtggggtcgcaacgtcaatcaaggtgttacgcaatcaactcgaacgggctggtcatcaagtctatatctttacgaccacggatccccatgttgataagaatatttatgaacgcaatatttttcggtttacgagtattccatttgtttcgttcacggatcggcgcatcgccgttcgcgggctttttaaggcttaccaggttgctaaggatcttggcctggatattgttcatacgcagacagaattctccatggggatgattggtaagtttgttgccaaacaattaaaagtcccatgtatccatacgtaccacacgatgtatgaggattatctacattatattgcgaatggtaagttgttaaagccataccacgttaaggaggccacacgggcgtattgttatcatctgaacgggattgtagcaccgagtgagcgggttgcaaatacactgacgggctacggcgttaaagcgccaattcgcattattccgactggaatcgacattaatcagtacgagcagcagtcgacggtggattatcggcaaagactcggctatcagtctgatacgccagtattactttccttgagtcgtttggcctacgagaaaaacattcacgaagtcattgcagccctaccggcgatcttagaacaggtgccgaatgcccaactcctgattgtaggtgatggtccggcacgtgaaacactggaaaatcaggttcaagacgccggcttaacggcgcacgtacaatttaccggtgaaattgataatgatgaagtttataactattaccagatggctgacctgttcgtttcggcttcgaactcagaatcacaggggctgacgtacattgaagcaatggctgcgggccttaaaacggtagtggctgctagtccgtacacggatcaattacttgatgatccgtcactggggacgacctttacaagtgagaccgatctgatcaaggatgttgtgcgttatttacaacatcccaatacttttaacgatcccaagccacggcagaagaagctttaccaaatttccgcagagtatttcggcaagcaagtgatcaactactatcaagacgtacagctggcgtattctgaatcagcggataaatcggcgaatattagtaattaacgtgtgtcaaatcgtcaatgagcaccgccaaaccggggatgcttattcgacgtatgacgcgtaaggggacgaattatgttagacattaccatgttttcaaaagctgactccgtcaagggtcagggagtcggcagcgcctatttagaattgatgcggttgttgcggacccattggcaggatgaatttaatattaaagtcaatcgatatgggcgctccgccgtttcacattaccatacggttaatccaatgttttacctgtctacgtttatgcctaatcgaggccgtaaaatcggttacgtgcatttcttaccagagacgctcgagggtagcttgaagttgccacgaccattccaaatgattttcaatcgttatttaatctcattttataagcggatggaccacattgtggtggtgaacccgactttcattccaaaattggaagcataccatatcaaaagagcagatgtaacgtatattccgaattttgtcagcaaacgtgaattttacgaaatgactaaggctaaacagttgcgcttgcgccaacaatacggctatgatcaaaataaattcatgattatcgggaccggtcagattcaggatcggaaaggtgttcctgattttattacgcttgcaaagcagaatccagatatccagtttgtatgggccggtgggttctcgtttggccgaattacggatggttatcaggagttgaagcaggtggtggataacccgccagctaatctgtcgtttccaggcatcgttcctcgtgagaaattggtggactattataatatggcggatcttttcttactgccttcttataacgagttatttccgatgtccgtgttggaagccttcagttgtgggacaccagtattgctccgggatttagatttgtaccgggcaatcattgatggctactatcaagcagccagtgatgttgatgatatgcaacgacagatcgaccagttacgccataatccagccgggttgcaattcttgcatgacaaggcggttttggctgctcaggattattcggaagagcgccttgccaaagtttggcatgatttttatttgcaacaggcaaaagaggggtagtcaatgacaagaaaaaatatctggtcattactcgtaatggttgcgttaggcgtcggcatttcgtggtactcactgcgcaatgtcaaactaagcaatctaatggacgatattctcactttgaattggtggtggttattagttgcgttagggtgtgtcggactatacttcggtctggaagccgtggtggtgcaaaagtttgtcaggcaccgttatcggaactatcgctttaagagtgccctgcgcgttcctttagccgagcaactattcaacggtatcaccccgttttcttcgggtggccaacctgcccaaatcttcgtgatggcacaatcagggattgacgctgggcgggcaagttcagttgcattgatgaagtttgttgtttttcaggccatggtggtattgaatttcttattcgccatgttaattggttttcattacttagctgaaaagttaagttacctgtcactatacgttttgttaggttttctgattcactttgcggtgattgttggtctgttgctggtgatgtactggtataactttacaaaacgagcggtgaagatcgtcttgatcccggtcagctggtttatgaaagctgagcgatttgccaagtttgaaaacaatattagtgaaaaaatcgattcgttctacgaagaaagcgttcgaatgaccaaggactggcggatgctggtcgaagtttgtatcgtcaccttcttacagctactgttttactacctgattccgtattttattatgcgggcaatgggaatcgatgatgttaatttgattatggtgactagtttgaacgtgttgatcttcttagtgacatcactattcccgattccaggtggggccggtggtgctgaatttggtttcacggcgttgtttgctaagttcattcccagccacagtaagctgattttagcgatgctgatctggcggatcttaacgtattatttaggactattcttagggatgatcgccatggcgatgcggcctgaaaaagcagaagaaattccgattgcggcacctagccggtcggattcacaagaacagtaattttaatgggccgacatcattgttcgacccatttttcgcggttacgaattaaaggaaggtactatgttaaagttaatcaaacaacggttggtatggggactagtgttgacagcgacagtcagcggggtgttgagctgcaatgtagcggcacacgcgaccagtagtaaggcggatgaggtcaaagccgcctacgtgatggatgccaagtctggtcaggtcgtttatgcgcagaatgccgatcagaaattaccaattgcgtccttgagtaagctcatgacgctgtatttagttgaacgggccatcgagcatggtcaaatcaagtggacggatgcagtcccaattcgcaaaaatgtccgcaagatggcaaccagtgcaactttatccgtaatgccgatgcctgccaaggagacgtttacggttagggagttattcgcagctaccttggtagggtcttcgaatagtggtgccattgcgctgggggagtatgttgctggcagtaatgataagttcattaaattaatgaatcaacaagcggccaaatggcatttggatgcgagttttattagcgcttcgggacttgataatactgatttaaaaaattacgatttaaaaatcaagggaaccagcgatcaggaccaaaatctggtgtcagcaagggctgtgacgaccattgcacaacatttgattgatgcttaccccgatgttattcaagttgctaatcaacgttcagtcaaaattcataagtatactgtcccaacttcggtggagatcctgaagggcgccgagtactatgatccccgcgtgccagtcgatggactgaagaccggttatacgaatcaggccggtgcttgcttagtcgctacataccggcagaacggccaccggatgattgcaacaacacttggcggtgcgtggcagtttacggcgaacaacaacttgcggctgatgctcaaaacgaccgagcagtataaacaggttgtacctaagagcatcaattatcagattccggggacgcagaccaaagtgcgtctggtgacgaagtacaattcaaaactgtgggtgaatagtaagcagccaataacgcagaccaaaattgctttgtggccattacatcggacagcgccaaattatctggctgctaatacggccgttcttaaattgcgattgacggatccattgtcaggaacgacgaaggaagtcatttatcggacgcctgaagcgctgacgatgcttggaccacttcaatgggcaacggcgcccgcgaaacggaccaccacgggcacgtatgcgttcgcaaagtgatgctcgcttaatagatcgtgtgatgctgaagacaaataaaggtgcgccaactatcgtaatttacgagtagttggcgcacctttttgagttgaatccaattcagtcattgaaatgactaacagtgatgaactaggacagttagctggtggactgtcgttgcttagttgatacagttagcaggttcctgcatatatgcagtgaggcgatccatggcctggtggagcttttccatgctagcagcgtaacttagacgcacgtagccttccccctcggcaccaaaaccagtccctggaataatcgcgagctgattcttgcgtgctaagtctttacagaatgccatcgagtcttgttcaaagccagctggaattttcgcgaagatataaaaggctccggtaggacgtgcgattttgaaaccgagcttcgacatcgtttgataaacgaaatcacgccgagcttggtattcttgccgcattggttgcgcatcatcgattccgttggtgagggcttcaacaccggccttctgagcaatcgtggttgctgcagtgacgtagtattggtggacttttttaagttgggccgtcatttccttagaggcaaacaggaagccgattcgccagccagtcatagcatgagacttcgataagccattgatcaggatcacttcgtcaggaatgaatttagcaattgagacgtggtcgctaccgtaagtcagttcactgtaaatttcatcggatacgacccacaagttatggcgatggaaacagtcggcgagcgctttgatttcatcttcaacataggtgacaccagtggggttattcgggtagtttaacacgattcccttgaagttctcgtcaggatgagcagcaataaaatcgtcgaccatcttaggcgtaatgacaaaatcgttaacgcctgtatccatgaagaggggcttggcgtgtgcttcttgaatgatggggatgtacgctggaaagattggggacggaatgataatggcgtcgccaggattacagatcgtcgttaatgcagttgcgatagcttcagtcgctcccacggtcactaagacttggtcttcagcatcatagtggacgccgtactttgtctcttgaaagtgggcggccgcttggcgtagctccaacagacctgccatgccagtatagtgggagtagttgtcatcaatcgcctttttagcaaccgctttaacgtgctcaggcgtgttgaaatcgggttcaccgagcgttaacttgaccatatcaggtatcgcactaacttcttcgtcaaactggcggatggttgaaacttgaatgtgactgatggtttcattgagatcgtctctaaatagtgtcatatatccgaactcctttaatttataagttgttctaattttagcacaacttctcaccgtcttagcaggaagttagggtataattataagtgtgaaaatttgtggtaaaaatgggctttctactaaaaaaacgtgttattagtcctattttttgctagaatgtaaacaaaacttgaaggagcgagattagtataatggataaatctgaactatcagcaattctcaaacgactagaagccatgcgcacaactgaagcaaccgaagtgcaatcacggcggttcgaaaaggaaggcgttcaacgtgggcaagtagcgtatgatcccgctacctcgacgtacacgttacaagaattcaatccagaccaaacgtttgaatttgataacattgacctcgtggcaattgaattatacgatttgctaacggataactagattcccccaaaatccagatagattttcgatagatccatattatgacgcgttgtaatgttgaagaatttttgaagaaatcttcaagatattgctaactagtacgcaaccgttataatatggatttgttaatagcaataacggaggaagaaattaccatgcctaaatttataaaaaacacggttgggaaggtcaacacaacgttgggcttttacctcctaaccgtggtcttattttggctaaagacatatatcgcttataagagcgagtttactttaggggttaagggacccgttcaggaatttatcttgttcttgaatccatttccgacagcgatcgtgctgctcggtattgccctatatttccgtggtcgcttaaagtattggattatgatgatcattgacgccctacagacgacgtggttatttgccaatatcttgtattaccgggaattctctgatttcatgtcggcgggggtaattaagagttccggtgctgctagtaataacctcggaaagagtttgggacagatcattcatggaaccgacttcctagtttatgcagatgtcgtgttgctgattctgttattagccttcaaggtcattcggatcgatccacggcctttcaaaattcggtatgctgcaacactgaccatgattggggtggcgttgtttgctgttgacctcggcatgtctgaacatgaccgttcagatttattgacgcggacttttgataacaactacatcgttaagtacttgggactcaacacatatgcagggtatagcttctatcagaccgaaaaggaaagtgcgacgcgcgcccaagcaagtagtagtgatatgaagagtgtgttagcctacctcaagaaaaaccaggctggcgagaacgtcaaatacttttgtaaagcgaagggcaagaacgtcttcgtgattcatttggaaagtttccagcaatttttaattgattataaggtcgatggtaaggaagttaccccgaacctgaacaagttctatcatgataagagtactttgagttttgataatttctaccatcaagtggcgcaagggaagacctctgatgctgaaatgatgatggaaaactccttgtttggtttaccaaccgggtcagcgatgacgcagtatgggacgtcgaatacgttccaggcagcgccagcaatcctgtcacaaaagggctatacgactgcggctttccacggtgatgtggctagtttctggaatcgggataacgcgtataagtcgtgggggtataactacttcttctactcttcttactataaagagaagtcagactacaatattggttatggcttgaaggataaaatcttcttcaaagactctgttaagtatttggagcaattaccacaaccattctacgcaaagctgattacgttgacgaaccactatccatacgaattggataagaaaaaccagtcaatcgataagacgacgaccggggattcaaccgttgatggctacgttcaaacggcccattatcttgatcaagcctttgccgaattcattagttacttgaagaaggccggcttatataagaatagtatgattgtgctttatggagatcattatgggatttcaaacaaccataaggctgccattgcacagttattgggtaaaaagtcggtaacgagtttcgacttggctcaattccagaaagtaccatttatgattcattctgaaggaatcaagggtggtattaaccacacgtatggtggtgaaattgatgcgttgccaacgatttttgacctgttagggatcaagaacaagggttacatccagttcggaacggacttactgtcgaaacagcataaccagacagtggctttccggaacggggattttgtctcaccgacatatacgaagatcagtgggacagtctatgattcgaagaccggtaagaagctaacggatatgacgacgaagcagaaggatactgtcaaacagatgcaaaatcatgtgacgacggaactctcactctctgatcgggtcatccagggtgacttactacggttctacacgcctaagggctttaagaaggtcaataagtcggactatagttataagctgactaagaccctcaaatcattgaaagagatccaagctgagaagaagacgagtgttctctcgaagcataagggcaaatcaacggagagtctgtataagacggatgcaccagaactgtctagctcaagtgacagtagtagtagttcaagcagtagttctgattaatcgaactcgtatcaactaagggataacgctgacggcgttatccctttttggttgcggaaataagctgccacttgttttgaccacagcgcggtacactattattaagccgattgttgcgcagtgtgaattgacactgatggtgaacgatgaagtattaccaattttggagtcccaagtaaatgcaaagttggaatggtaggcgcgtcgcggatgttgtgaaccgataaagtacggtgatgaggtggggaatgctgactgattggttgtcttgatttggtagattgtcagcgaaataatattcattatgctagcgttggtttactttgaaaaacagtcgttgaaaattaaagggagatttattgaacttttgcttgctatcttaataaaaaccccgtaaaatatagtctattgcgacattaatcggtgtttaaaacttttctgaaattaattcataaaaagggttgacccgggtcgttattcttggtattatatttcttgtcgttaagagcgatatgcaacattactcattattatgaatattcaaattgatgtgagcatttacattgaatagttattcaaaataatttataaaaagatgttgacagcttgttctgatgatgataaactttaatagttgcgttgaggtaatcaacgaacgatttagatctttgaaaactgaacaaagtttcgacgaatcaaatgtgtagggtctcttgattttgaatcaagagcaaaacatttgcgaagtcaattcgctagcaaataaattttagtacaacattaaatgagctttttagaactcatcattaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaacctttttaggaaccagccgcctaaggtgggacagatgattagggtgaagtcgtaacaaggtagccgtaggagaacctgcggctggatcacctcctttctaaggaatattacggaaacctacacattcttcgaaactttgtttagttttgagaggtctaactctcaatttaataagcgttttttgggcctatagctcagctggtttagagcgcacgcctgataagcgtgaggtcgatggttcaagtccatttaggcccattggaaccgaaccagttggttccataagttgaatacctcatggggaattagctcagctgggagagcacctgctttgcaagcagggggtcagcggttcgatcccgctattctccattgacgacgttagtcgtcattgaaacttgttctttgaaaactagataatatcaaatatattttttcataatgaaaccgagaacaccgcgttttttgagttttttattgaagtttaattatcgctaaactcattaatcgcatttaccgttaggtaaatgaggttaagttaacaagggcgcatggtgaatgccttggcactaggagccgatgaaggacgggactaacaccgatatgcttcggggagctgtacgtaagctatgatccggagatttccgaatggggcaacccagcagttttaatcaactgttaccactagatgaattcatagtctagttggaggtaaacgctgtgaactgaaacatctcattagcagcaggaatataaagaaatttcgattccctaagtagcggcgagcgaacggggaacagcccaaaccaaagtgcttgcactttggggttgtaggactgaacatttgagttaccaaagaacttgatagtcgaaggatttgggaaaatccgccatagatggtgatagcccagtagattaaatcaaattctctcagttcaggatcctgagtacggcggaacacgtgaaattccgtcggaatccgggaggaccatctcccaaggctaaatactacctagtgaccgatagtgaaccagtaccgtgagggaaaggtgaaaagcaccccgggaggggagtgaaatagttcctgaaaccatgtgcctacaataagtcagagcgcgttaatgcgtgatggcgtgccttttgtagaatgaaccggcgagttatgatcccgtgcaaggttaagactaaaaagtcggagccgtagcgaaagcgagtctgaaatgggcgttttgagtacgaggttatagacccgaaaccaggtgacctatccatgtccaggttgaaggtgcggtaaaacgcactggaggaccgaacccgtgtaagttgaaaattgctgggatgaggtgtggatagcggtgaaattccaaacgaacttggagatagctggttctctccgaaatagctttagggctagcctcggaattaggatcatggaggtagagcactatttggactaggggcccgtcttgggttactgaattcagataaactccgaatgccattgattcatatccgggagtcagacgatgagtgataagatccaccgtcgaaaggggaacagcccagaccatcagttaaggtccctaaatgtatgctaagtggaaaaggatgtggagttgcatagacaactaggatgttggctcagaagcagccaccatttaaagagtgcgtaatagctcactagtcgagtgatcctgcgccgaaaatgtaccggggctaagcatactaccgaaaccatggatgcgaccattaggtcgcgtgataggagagcgttctaagggcggtgaagcaagatcgtgaggacttgtggagcgcttagaagtgagaatgccggtatgagtagcgaaagataggtgagaatcctatccaccgaatgactaaggtttcctggggaaggctcgtcctcccagggttagtcgggacctaagtcgaggccgagaggcgtagacgatggataacaggttgagattcctgtactagttaagtgcgtttgagcaatggagggacgcaggaggctaagatgtgcattctgttggattagaatgtccaagcagtaagtcttgtgaagagtcaaatgcttttcactttaaggacaagctgtgatggggagcgaaatttagtagcgaagcgtctgatgtcacactgccgagaaaagcttctagtgagtacttaactacccgtaccgcaaaccgacacaggtagtcgaggagagaatcctaaggtgagcgagtgaactctcgttaaggaactcggcaaaatgaccccgtaacttcgggagaaggggtgctgatcgcaagatcagccgcagtgaataggcccaggcgactgtttatcaaaaacacaggtctctgcaaaatcgtaagatgacgtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcactgtctcaacgagagactcggtgaaattatattgtccgtgaagatgcggactacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaccactctaacccgcaccactaatcgtggtgggagacagtgtcaggtgggcagtttgactggggcggtcgcctcctaaaaagtaacggaggcgcccaaaggttccctcagaatggttggaaatcattcgcagagtgtaaaggcacaagggagcttgactgcgagacagacaggtcgagcagggacgaaagtcgggcttagtgatccggtggtaccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacatacctctggtgtaccagttgtgccgccaggcgcatcgctgggtagctacgtatggatgtgataaacgctgaaagcatctaagtgtgaaacacacctcgagatgagatttcccattcctttatggaagtaagacccctgaaagatgatcaggtagataggttagaagtggcagtgcggtgacgcatgaagcggactaatactaatcggtcgaggacttaaccaagtaattggtgttccggttcatatgaagatatttgatattagctagttttgagagcacaagtttctcaatagtgtggtgacgatggcgagaaggatacacctgttcccatgtcgaacacagaagttaagcttcttagcgccgagagtagttgggggatcgctccctgcgagggtaggacgttgccatgcgattattccgacatagctcagttggtagagcgcttgactgttaatcaagatgtcgacggttcgagcccgcctgtcggagttatctacggtaagccatggagagttgtccgagtggctgaaggagcagcattggaaatgctgtaaacgggttatacctgtttcaagggttcgaatcccttactctccgttagttagatataataaatatgaccccttggtcaagtggtttaagacactgccctttcacggcagtaacatgggttcgaatcccgtaggggtcattatggaggattagctcagttgggagagcgtctgccttacaagcagagggtcacaggttcgagccctgtatcctccatctgatgagagttactcatcaataatttaatagactccatcatgaagaatgatatggctcggtagctcagtcggtagagcaatggattgaagctccatgtgtcggcggttcgattccgtcccgcgccatttatggaggggtagcgaagtctggctaaacgcggcggactgtaaatccgctccttcgggttcggtggttcgaatccactcccctccattctttatagggatatagtttaatggtagaacaacggtctccaaaaccgtcggtgtgggttcaactcctactatccctgccatgatggcggtagtggcgaagtggttaacgcaccggattgtggctccggcacgcgtgggttcgattcccacctaccgccctttgattgggttatagccaagtggtaaggcaatggactttgactccatcatgcgctggttcgaatccagctaacccagttgggtttgggcaataaatgatggcggtatagccaagtggtaaggcagaggtctgcaaaaccttcatcaccggttcaaatccggttaccgcctttcctgaaaaggttataatcctgatcagatttatgttccatctagttattattttgccggcgtggcggaattggcagacgcgctggactcaaaatccagttcccgttgagggagtatcggttcgaccccgatcgccggtactaagaggttttcaggaagctctaagtacctttaagaagtcgttatatcgttgatataacggcttttttgtattcttagaatcatgcgaaaataggcaaaatgatttttgggtgaactttccaattgcaaagaataaatttacaatattagcattgcatgaatatgaacgtagaaatagtctcgtaagcatcgaaaagccctgtattagcataaatcatgctaacatagggcttttcatattatggtaggtctttaaaacgaatccatccatctaaaacttgctcgttgcactcggtgataactgaagtagttggtttaagtccatggtgcttgttctgctttgtgactcgctagtgagttgtaatgtgtttctgaaccgcagctaggcaaataatggtaacggtgccaaaaaatcgatatctgttcgttcgctggcggcgccttctgctaaaattgccatctgcttgaccacttgggcgccagcttggtgtaggagggcgttggcagctgtcaacgagcccccactgctaatgacgtcgtcgataatgataacgcgcttatgattgattagtgcggcgtcagtaccatctaaaactagctgttgtggggtgctggtcgtaattgcgcttaccggttcgataagcgggtgctgcatgtaatccttacgattcttacgtaaaacgataaagcgagggtggtttgtggcctggcttagtgcctgggctagcggaatgcccttactttccatcgtgactaaataatcaaatttagtggtagttagccgttgactgagctgacgggcagcatagtcggtcagctcagcgtcgcccaatagaacgaaagaggcgatgctagtcgtggcatttaatcgaatcaatggtaactgccgtgtcagcgatcctaatgttaactgataagtttgcatatttataaccccaatccaattaatggtaaaccaaattttaggagtgccccggtcattagccccgcgaatggatcgacaagggcggtcacgacgagcgttacgcctgcaaccgtacttaacgagccgtgcaaagcggtggttgcattttccgggaaaatgacaatggtccctaagataaacaaaaaaccggcgattgcagtgctaggcacaacttttcccagctttggcagccatcccagtaatagaatcagcatcatgatcaacatcattaggatacccgcgattactggttcaggcgcgctggctgtcgcggaaataatcgtttctactggcgcaccacccagaaggctagttcccaggtctgctaatgcctgactactagtcagtagatttagattgaccgggttggggtgttgtcccgtcatttggccagtaattaagccgtacgagaggttagcaccgatattaagacaagctagactcagagcacctcgcaggattttaaaactgaactgtggcctgacaaattgtaatttgcgggtcgtcacatgttccggtagtgcgacgcgataatgtgtcgtcgctgcgtaacagctggttccaatcactgaaacggcaattgtccatactaaatctttactgatcaaataagtcacacccgccaagccgattgacagccacccaaattggggttgttcgtgcgccatttgcaacgcgattttagccaacatcaggccaactcctgccatcatcgctgccataagctgattgcccagactatgaacgatgagcggcagagtaccggtcaagccaatcacgaacatcagactcgcacctaaaaagataatcgacgaccgttcgcgtaaatcgtgtcccaggtgcccgactagtgcgagggattccgcttgaaatgaaaccggtgcaactgaactagccacgccgttgattaaaccaactaatccgaatgaaaatgcagtcggaaagaccgcaaaaccgagactcatcgccataattccttgtgggatcccgtttaaaacgaccccgattgctgccaatagatccgccaaccaatgcatattaataccgcctttcttgtttatacgaataatatacgactgattagggtttaaatccagcaaatttaggacaaagtcagaataatattgtttgttaactatttatagttcgcgttttcacgaatcacgattagttggcgcacgctcgcaaatggggtatacttagtgctaattagtgaaggaggggtggcaccatgccaacgattaaagattattacttgccaaagcggccaacattattattttcgttgcatccagagccaacacaagcgattatcaatggcaccaagattctggaatatcgtcggcgtttttttgcacgtccgtttcaagcatttgtctatacgacgggggctaatgggggaattcaactctttttgcgttgtgatcagggtctgcaactcgtgcctgaacaattagcgcttgtgggcgcattgttacagcatgacgcgcccacaaccaccgcggcttattttgaaggcgctaaagccggattggcgttaccgattacggcttttacaaccttacctaacattccgttggcacagttacgtcgtcagtttgaaaactttgttacgccgcggagttatgtcttcttagatcagcctgaccggcaagcacagttggattggctattaacgcaaccctgtgagtcgctaactattttggactggcgcaaacggtatgcagcactggcgactttgttacaaaaatgaagccaagcttgtcttaatcgggctgcaactagtgcgccggttataagaatcaaacagccactcgttgtgtatttgctgagcaaaaggacttagctgtgacaactgccgcaaacgagtagtcatttagcatgactgattggatttgatcgtaaaaaaagaacctgccacaagtggtcaggttctcagattaattagagcattttttcatagacgtagcaaacgtcatcgacatggtatacaccgaccatttcgccaactcgcttgaagttcatctttgcaatcagatgttgcatcgcttgattgtcggcatgagtatcgatacggatgctcttgatttcaggatgatccgcagcaatatgagcaatgattttttcgaataattgagtggcataaccatgacctgcatggctagaatgaatcgcgactcggtgaatcacgacgtaaggtgccgtggtatttaaccattcggccttcgcagtatcgtaagtttcgtctggtgaaggcacgacagcgacagcgccgaccgttgcgttgtcgtcggcattgaataagtatgctgatccttgcatgatgtcggccgtgatttgtttgctagacgggtagtcgccttgccactggttgaccccagcttcagcaagttgattacggccgtcactcagaatgtcgatgatcgtatcgagatcatcgagggtcgcttttttaaagtacataattctagctcctctcttgaacagcgattgactgccgaagcagtaatcgacttttaaaagtatacagaatttttagaaaaatgaaactattttctaccgattcttaggagattttcagtgacgattttcaagtaaaatcttgcgcgcttctcgggccatgtcatgttgcgtattataagcagcgaccgcactcggtgcatattggtaagtattagtccgcaaagtttgttcatagaattcgaagtagggtaagtgggtattttgcgcaatcgtgatagcacgctgccaatcgaaatctacggcgcggtaatcagcatgctggaggccagtctcatcaattgtcagaagcaagtagtttgctcgtggttggcgtaggtggggattaatggtagtcggaagaccaactgtcccggcgtttagaatcaactgtcccgtggttgcgtagcgcatgatgggctggtgcgtgtgcgcgtagatgacgatatcgacatcgccttcagcggcttggtcaaagttggcctgactggcagttggtgcgagcgcgtgtccactagcgacggtcggtaaaacgtgttggagacggatggttaacgggccgacgtgtttgatgactgtcattggtaagttcagtaaccgttcaaagtgtgtcgaactcagctggcgccaatcaaaagcggtgagaaccgttgccataatttgtttgggtttagtaaacgtgttgggattggctgccattactttttggtagttttcctcgtgatttccgagaacgtaggcggtggggtgaacgcggtctagtaaggtgagacagcgctccgattctggcccgcgaacggtcatgtcgcctactgtccagtattcgtcaacgtgttgtttctgggcgtctgctaagactgcttcgagtgcagtagcgttaccgtgaacgtcagataggactgcaatttttaccatgttgagatgcttcctttctactatgtaatctaagctctggtgagatgttttattctggtaaacgtgggttttaaaaatttatgaatgtaaccactatgaaaagccatcgtaacttttatctgttataatgggtatgaaacgaagtaatatatagcacgtatattcaagccaattcgtttcgtgccgtggttatccttgcgataatcacggtttttattttaccatagtgttattaagtgtctggttaataattgtcaattcagatgtttatttttgcaagttctaggtatttgaaaatagcatgttaaacggatgaatgggtgccagcactaatcgctaaggaggtagcgtacttgtcaacaagatttcaacatgaaatagtcacgcgtacacagcccttatcagcttgggttcacttgcacgattctaaggcgccacagcgaattgcgccacactggcatcaaggtatcgaactttcgtatacgctcagtggtcacattgacgattttacaatcaatggtcgagattatcagactaaatcagggtcaatattagttgtgaattcacaactaattcatagcgttcgaacgatcaatacagcaaatagttgtgcgttatcaataatctatccgtacgattatgtgcatcgactttatccgtccattgagcatgaagtaatcgcgattaacgaaccagcgtatttttcagagcagcagtcggcggtatacctagatttacagggagatttatatcaactagcactcgcgttacaacagtcaactgcgtatacgaacctacgaattgaggcgctaacaactgcaatcctccaacgcttattgatctattttacgacggctaaggcaagttctggtgtgatttatgggaaagcacctcagattgttgagcgaattcaaaaaattaccatgtacgtcaatcaacattatacacagccaattagcttatcagacatcgcgcaacagattaatgtgaccaagaatatttgacgcgcttttttaagcaacatatggagatgacggtaggagaatatattagtttggtgcgtgcccaacatgcctatgaagatctgctaggtcagcgtggaaatttgaccgcaattgcgacgatgaacggttttccaagtacgcgtgccctaaatcatgcttttcaagcggtgtatcatcaaactgcagcgacaatttacaaaactgaacatacattagactaactgtttatggacgatgttctgaaagaggtttagattctgctactaactggttgatattgctatattaatcggctagtagtttttttatgatagagccaataaatggaggcgcttacaatgatatcaaaagaattgagtcggtcaataattgaattgcgaaccgcatttaagaaaaatgatgatgcgcgtgacgctgggttacctcgtgaagtggctggtgtcgagagattagataatctaagttatggtcctgaccccaagtggcatttgttggatttatatcggcctactaaggtcattaaaccattgcctgtgattatcaatattcacggtggtggatggtgttatggcactaaagaaacttatcaattttatggtctgaattgggcccaacgaggatttgccttcgttaaccctaactatcgtttggccccagatgtgacttttccaggtgaattggatgatgtagatcgttatattcattgggtagcggaacatgcagccgaatataacctagacagtaataatgttttcttgattggtgacagtgcaggtggtgagatggccgagcagtatgcaacgattctgactaatccggaatatcggtccaagtttggttacgagctaactaatctgaaatttcgcgcagtcgtgctcaatagtgcggcggcatttccgctagacgaaggcatggtgacaggtgcagttgctgcatactttactcccagcatcatccgccaacaacgagaacagattatggcagaaaactacattcagaaaaattatctgccaacattcatttgtacggcgacagcggactttttgcgtaataacgcggctaagctcgatggattcttaactgccaagaaagttgaacacgtttttaaaatgtatggtgatgatgatcatcctcgcgggcatgtttttctgattagtcaaaaggatgaattagcacaacaagcgacggatgatgaaatgcgctttttgcaggaacatatggcctgacctaatctggaggaaaatatgatgaaggacaaacaaaatcatttattgtttaaagtttcattattatcaatttcattatttttgatgatggcgccgcaaatttcttcggcgctaccgttgatgtaccatgctttcccgggaattcaacaaggccggtgttcagacgcttgcaacgattcctaattttggaattgtggcggggctgcttgtcagtccgttgatggtccgctggtgtcatgaaaaactaaccattgttattggcctggttgtcaccctattggcagggacctttccaatgtacgccacggcctacagtgcaatcttagtttcccgttttctaatcggtgctgggattgggctattcaactcactggctgttagtttgattccacaattctataagcgtgatgaaaatgagttggcgcaaatgattggctatcagaacgtgatgggaagtgttggggccgccattgcctcattcttagttagttatttagtaacgatcagttggcatgccgcctttgccatttacctactcgttattcccgcgttgattttatttacattgtttgtgccgttaccacggccagttatacaggcagctagccaatccaaaaaggcagcgacagtcacacgaaaaatcaatatgccagtcgtggtaattgcagtgttgatgtttttagtctttatgttctacatgccgttttcttatgaattaccaagcttgatcgtcgcaaacggtatggggaccagtagtacggctgccttgattgctggattatcaacattggtcagtattccagtgggcgctagttttggcttcttctttaaacgattacatgatcgtattttcccgttggtttttttgctagttgctgtgggcttcattctgattgcagttgcaactaatattgtttttttattcgttgcggttgtgattctgggctttggttttggtatcggtgtcccatacttatacaattggttggactgggcggccccggaatcatccttgaacttggcaacgacgattgtgttagtgttggtcaatattggttgctttgtctcaccaaccattatggatgtgctggctaatatagttggtcatggcacgccccggggagttatgatgttgagtggcgttgcctttctacttatagctgcctatgcgctcggacattatctacatgttcatcaagcgcaggctaacattacgggtggtacgcatgattaataattatttatgtcttgatattggtggtactagcctcaagtcgggactgatagatgcgaatggtcaattgcagcagtcacttgatgcagtgccaattgccaaaaataagcatgatttttggcaccagttaacagcaactatcgaccgctttcaagggcgctttgcgggaatggcaatcagcgttccgggtcaagtagacccccaacgcggtatcattcaccatggcggcgcactaccatacctggatcaatgcaacttacaggaatctttggaaaaccattatcaggttccagtagcggttgaaaatgatggtaaggcggcggctttagccgaaaaatggcgcggaacattacaatattgccaaaatggtttagtcttagtgcttggaactggggttggtggtggcttaatcattaataatcagctctatcgaggtagtcattttcaagctggtgagttgagtctgatgttagccgcaacgactggaactaatttcaaaataacgggtgagacgggttctgcagtgaaaatgattacggcaattgcgcaccaattacagttacctgatcgacatgatggtcatcaggtgtttgccgcgatagctgacggcaacccggatgctgaacgcatctttgaagcttatggtatggaggtcgcacaaattatcttaaacgttcaagcagtactggatgtaatgaccgtcgcaatcggtggtggcatcagtgctcaaccgagtgttgtgcccatgatccgtaaacagtatgcggcgctgctgcaacagtatcctgtaattggaacgactttatcaaagccagagattgtgcctgctaagtttcataatcaggccaacatgattggtgctttagcgggactgctgaatcgctgaatatgactgactggcattgtttgtgcaactgtcttcttcaaaagttctgtcagtttttagcaaagtaaaagataaggaccccattttgaatctatcagaatggggtccttattgaaataacggggattagattgccaatatattgcataatctcaaaacaagctatacaccaaataaatattcaacaccgtaataattccagccagtccatatcccaaccacgttaccgctgggcgattaacgtgggtcttcatcaggctggcgtcatttgtcagcgcaactagtggcaacaaggtaaaggggagggcgatgctgagtgccacttgcgcgtaaatgatcaagttttcaaaggcagcgtcactaaagccgactaacataccgataatcagaatcggaattagcgtgacagcgcgagtaagcagacggcgttgccatagcggtaagcggatgtgtaaataaccttccatgacgatctgaccagctaaggtgctagtgatggatgaaattaggccggtaattagtagggctaatgcaaataaccagctcatgaccgggctagcaagggcgccaaccacggtggtactttttaacccatcgaagacggcctgcagactcgctaacgcgttggtgtgaccgaagaaaagcgtcccaccaaggacgagcaaaagtgcgttgatgagaaaagccgcaatcaagtgcactgttgagtcccaattggcgaagcgcagtgcttctgtgacttgggctggattatgataatcataacgccggctttgtgcaagcgatgagtgtaagtataagttatgtggcatgatggttgcgcccaagattccgagactgaggactagtgcggtatgatttttgacgatcaatggtgttggaactaagccgagcaacacgttgccaaattgaacgtgggcccgtcccacctcgataccaaaaataatgccgacggtcaaaatagcgacgaggacgattacttcgacacgccgaatgccaaatctcaaaaacaacaagacaactaagacgtccgcaatcgtcagtaaaattcctgcaagtagtggtaagccgaataacatttttaaggcgattgcggttccaattacgcccgtcatatcagtcgccatcatcgcgacttcgtttaaaatccacgcggcgtaacgcacgggccggggcagcttgctagcgatggcttgtgctaagtcttgccgggctacaacgcctagcctgattgccaggccttgcatgaacatggcgacaatgatggctaatgcgagcacgactaaaagccggtactgaaactgaccgccaccggctagggatgtcaaccagttgccgggatccatatagccgactgccactagtgcaccgggaccgctataggctaaaaatttgcgccaaaaggccgtctgatgaacgtcgggaaccgcgacgctctgattgatttcttcaagactttgatgacgatgcgattgcatggttcgacgcctcctgcttttggatagcgaggtcagccagaaattggctgaagccggtatccttattcatcggtggtactaagtcaaaccgatcaccaccgcttgcccgaaaggtttgataattttgaacgtagtcttcctcgagggtttccaagcagtccacgacaaaggatggcgtaactactaatacgttgcgtttgccaagttcgaccaactgcatgagctcattttttaagtaaggcttcaaccacggcatcggtccgaacttggactgatacgccgtaatgaccttatcagctggtaattctggtcgctccgccaacacagctttgttcgtggcctcgcattcgcgttgatagggatcaccatggcgtaccattgcagtggggatgctgtggtagctgaagatgaccgcatcataatgatgcgcctgatagctttgcaagactttggttgctagtaagtgaatgtaggtcggttggtcgtagaaactgtcgacaaaggtgtgtggtaatccagttgcttcaacttgacgatggatgtcgccgtgcgtgctctgggtgtattgcggaaaaagtggtaaaataattggcttttcacacccatcagcaaccatggctttcaaggtcgcaccgatatcgggttgaccgtacgtcattgctagtcggacgttccaatcgggtaatgctgcttgtacttgttggcagatggcttgactgtagacgattaatggtgagccttgtgggagccaactatcctgataaaaggtggccgaacgccaagaacgggtcggtaagataataccacgcaacagcggttgccagagtgcggctggcatctcgatgacgcttggatcacttaagaattcttgtaagtatgctttgacatccttagtccatggggatgctggggagcctaaattgacgagtaataatcctgggtgcatagaaacccctccaatgctcttgataaattaatcatagcataatcgtcagcttgtatacggggttaatggtttatttattcgattatctagtgataatcaatttactgctgaaataaataaaatctcttgctagcaactggccgggctagcaagagatctgaaattgatatttggttttgttgcagttcaaaaatcggtgtcgtcggctggatcgtactttaaaagtagattcagaaatgccagcaaaagccatgaccatgttcgtttttaggtcgtcaacatcaaaaggcgattactgggtggacttggtgagttgagctgactaacgggcttactttgcggcgtgggtccgtcgataacgttgattgagatagtagcctagatagcaaatcgccacgaagggaatggtgtaatacaaggcaatccgctggttagggtcaaaccaaatcaagatacaagagagcccacttaagataaaggccagccacgggacgaccgggtagccgggcgttttaaaagtcaattgatcaagcgaatgcccacttttcaggtaggctttgcggaagttgatctccgaaagggcaattgccatccaaacaatgacgacggcaagtcctgaaatggatactaagaccaggtacaccgaaccggcggcatagacactcgacaatagggccagaatgccacccagcatgctagtaattagggcgactaacggcacatcacgcttcgtggttcgtttgaaaacctttggaatggttccctcgttcgcaagtgaccacagcatgcgggtagacgcgtagaggccagaattagcggccgacataatggcggtcaatacgacgaaattcattaaatcagcggcgtagggaatcccaatcgctttgaagacgagcacgaatggactttgcgtcacacctgcttgtttgtaaggaatcagtgcggccatgacgaacatgctaccgatgaagaaaataatcaggcgccagagggtcgttttgattgcggtcggaatggtgtgggccggatccttagtctcaccagctgtaattccaattagctcagttccggaaaaggcaaagttgaccgttagcatagttgtaaagacgccaccaaaaccattgggaaaccaaccgttacgcgtatagttgctcagaaacggggcactggtatgaccgtgaagtggcagaataccgaccattgccagtccgcctaacacaataaaagcaacgatcgcgatgactttgatactggcaaaccagaattccgcttccgcaaaccagcgtacggagagggcgtttacggtgaagatgaccaccataaagacgaggctccagatccaggtcgcaatgtgcggaaaccaggtttgcatgatgagccccgctgctgtaaattctgaaccgagggcaatcgtccaagtcaaccaatataggatggcaaccgtaaagcctgtgccaggaccaatatattttttcgcataaacgtgaaacgccccggtgtagggcattgcaactgacagctcacctagacagagcatgacgagatagacgaggatggccccaatggtataggcgagcagggtcccaattggccccgcttgatgaatcgtgtaaccggaacttaaaaataatccggtcccaatcacgccaccgagtgaaatcatcagcacgtgccgtgattccatctggcgactgaggtgggtttgttttgacataatgtaccggccttccttacttgcagaattaatatgattagactatgattagaaaatcaacaatgctattagaataacataatttataagtagaaaggaaggcaattattgcaatgctttcattaactgaacaattgaaccggggcccagtcgtctcggacggtgcgatggctacggaattagaaaaacggggcgtggcaaccaatagcgcactgtggtcagccacggcaatgttggaccacccggatgcgattcaagcggtccatcagagctatctggatgcgggcgcaaaaatcatgacaactaatacataccaggccaacgtccctgcatttgagcaggctggtattgctgccgcacaagcgcgtcaattgatacaacaggcggtgacaattgcgcatacggcgcgtgatgctagtcatgtcacggatgctgtgattgctggtagtattggcccgtacggtgcttacttagcggatggtagtgagtacacgggtgcatatcagttaacgccgagtgcctatcaagactttcaccgcgaacgcctggcgttgatcatggccgccggggtggacgtgcttgcattagaaacgatgccacgtttagacgaagtacaggctttggtacaattaatcacaaccacttggccgcaacaaccatactgggtaagctttagtatcaaggatccacagacattatgtgatgggacgtcattagctgtggccgcaaagtgggtggcggcccagccgaacgtggtcgctgtgggggtcaattgcactacgctggaaaacattgcaccagctttaaccactttgaaggcggctgtagcggttccgttgatcgtttatcctaattctggtgatcaatataatcccgtgacgaagacttggcaagaaacttatttgagtcatcaatttgcatcctttgtcccccagtggttagccgccggggcccgcattatcggcggctgttgtcgcacaacgccgaaggatattgcgacggtggcacgggctctcagtgtttcggattccgccaagctttgaaaaatgttaagaaatgacggtgttttagttcatggtgggcgtgtctccgagatctaagttgtcttggggtgttcgttacatactaattattgatttaattatatttgagcaaaacaatacctagcgtgctgagcgtcactaggtatggctagcaatttaattgaaactggtgaaaaatcactagtcgggcactgctgatacggtagttgttcacgactagcgatttttgtatgtcaataaaactgttcatatcttggtcgagtaacgtaaaatatggtagggtaaagatagtgtatagatataacagatgaagtggtcaatcgtccgtgcgtactcgaagtttttgaactcggtgacagaatgagttgatttttcagattgagaagggaacggctaggtgatgtattattttgtgggtactggtttaggattgaaattgacgggaattgaaaaggcacagttgaaccgactggcgctatttgacgccgctggttatcaggctcgatgcgtctatgtcacttataatccgcgtttacatgagcatgcggcccgctttggtgcggaaggaaaatgctttagtttgtatgatttctttcaggggacgatgcctgaagcagtgactaaaatccatcatgattggatgcactattggcaagctgtttgtcactttaaggtgattcaggttccaaatacgacggattttcgcgtcctggataccgatggtcaatatttgatgtacgttcattttgtggacaccgggcgacaacaattggattatgtcaattattttgataatcagggtgttaaagtccgacgcgaattttatgataaccggggcttcctgagccggacaagctttttagtgaaacatcaggaagtgcacacagaagtgtattatgatttacaagggcaagtcaaaattatcaaaaagtatgatattaccgggccagagccaaaactacgactgattacgttgaagaactatcaacaaagagactttttcttcaataccgaacaggcttttcagacattcttcttcaatgagttggccactgctgatgacgtctatttctgtgatcgtaaccgacaaacggcggcggccttaggtcatacgcgccccgcaattcgcgtgtgttcagtcttacatagcacgcatctacggattggtgaggacgtggtaagtgggcatttgaaatcggtctatcggtatgtcctagcccatccagaccaatttcaccgaattattgtgtcgaccgagcatcaaaagcgtgatttgttggcacgctatgataatttaccaccagttgtcgtgattccagtcggctatacaacggttcatccggttaaaattgatggtcgtgacccgcaccgaattattagtgtggcgcgctattcgccggaaaagcaattaccacatcaactggaagtggttcgtcggttagttggtgaatttcccgacttgactttgcagttgtttgggcatgggcaaaagattgaaatgcaaatgcgtcaatttattcaggccaatcagctagaaaaaaatatcgttattcggggtttcttgcccaatctggcagaagagtaccagcgggcaagcctcgccttaatgacgagtgtggaagagggtttttcgctagccacaatggaagctgaaagctatggcgtgccggttattggctatcgaattgcgtacgggccggaagatattatcgaagatggcgttaacgggtacttagtgacacccaatgatgttgatgagttgacaatgaaagttcgtcagtatttacagcaccctgaacgacaagcacaactgattacgaatgcctacaattcagcaactcgttacagcaagcagacaattattgaaaagtggcgccagttaatagcagcactttaagaactggtgataggggcaaacaaggcgtctacctagtttgagagactaggtagacgccttgttgttatctagatattaataaagtaataaaatcagtgccaactgaacggctacgttgatcatgagatgtaaccgagtacggccaaaggactgttgactgaaccaaacagcaatcgtgatgagaattgcaacgatcgtttgccaggtcagcggctgcagtaagatggtgataacaagtagcaggccagtgatggccgaaatcagttgattgatttggcgctgacggctgaagctcggaacgtataggaagacataactagccagcatgggggccagtttccagagaaaagtagttgataaatagttattttgtaaatcgaagacggccactgggatcgtgaacgtcatgatgacgccgaaaacgactagaccaaagtagttttgcataccgaagcgtggaacagccatcacgagcaaccacgcactgcacgttaatagcaggtacagtagttcggactccttggcaataatgttggtaaatgcaaaggccacggtaattccaattgcaatgaggctccactggggagcaatccgccgatctaagataatgaagaccgcggcggccacggctaaggtgtagccaatcagtggtaactgcgcggctgaaaatgaggccgtttgaaatgagcgcccgtaatcgagggcggcccaccaactaatgatgctttgaacgatggtaaagatcgccaaggcgatgtaatcgcgtttaatatgtaattttccgattcgaatcatattgtcaacactctctaattaggataatgagttaatcgtaccggtcggggcagttcccgtcaataatttgacagaaatctttaaaaaaaatggtgattgtgataaccttatatagttatgagccgttcccgaaaggataagtttagcttgttcaatgaagaataagtgatgcttagatgccttgtaaccgaaattatcaagggggaatttattgtgagtgaaagacacttatttacatctgaatctgtctctgaaggtcatcctgataagattgctgaccaaatcagtgacgctatcttggacgcaatgttagcccaggatccacaagcacgggtcgctgttgaaacttcagtgacgactggattagtgctggtcttcggtgaagtttcgaccaaggcctacgttgatattcaaaaggtcgtgcgtgacacgatcaagtcgattggctatgttgatggtcaatacggctttgacggtgacaattgtgccgtccttgtctcattggatgaacaatcaccagatatcgcgcaaggggtcgatgattccttggagacgcgttctggcgatgctgacccattagatcaaatcggtgctggtgatcaagggatgatgtttggttatgccatcaacgaaacccctgaattaatgccactgccaatcgcattgagccatcggttgatgcgtaaaattgcagcgctacgtaaggatggtaccattaagtggttacgtccagatgctaaggcccaagtcacggtcgaatatgacgaagacaaccaacctaagcgaatcgacacggtggtcttgtctactcagcatgatcctgatgttgatttggacacgatccggcaaacggtcattgatcaagtcatcaaggctgtgttaccagctgatttattagatgaccaaactaagtatcttgtgaacccaactggtcgttttgttattggtggtcctcaaggggatgccggtttgactggtcggaaagtcatcgtggatacgtacggtggttttgcccatcatggtggtggtgccttttctggtaaggacgcgaccaaggttgatcgttctgcaagttacgctgctcgttacattgccaaaaacgttgtggctgccggtttagctgatcaggtcgaagtgcaattggcatatgccatcggggttgccgaaccagtttcgattgcagtggatactgccgggaccgggaaggttagtgatgaagcgttgattaacgccattcgcgaaaactttgatttacgtccagctgggattatcaaaatgctcgatttgcaacggccaatttatcggcaaactgcggcatacggccactttggtcggaccgatattgatttgccatgggaacatactgataaagtggatgctttaaaagcagcatttaaataatgcggtaacgttgattcgttacggtctgtaggtactcgacgctaaaagcgaccttttttcaaggtcgcttttttttgcgggctattttagatgcacggggttttaaaatgattgatagagaaggagaattactaagatgcaacagcgtaaaactaacgtaatggcggttacggttgccatttacgtcgcgacgtttatgagtgcgattgaagggacaatcgtgtcgaccgccttgccaacgattgttggtgatttacacggggtttcattgatgaattgggttttctcaatttatttattgactaatgcgatgatgacgccaatttatggaaagctgactgacttggtcggccgaaaaccagtgatgcaagccggactaattatttttattatcgggtctatgatgagcggtttgtctaattcgatgccggtgctaattttttggcgggccattcagggaatcggcgccggggcgctaatgccagtctcaatgacaattatcgcagatatttattcattcgaacgccgggccaaagtgctaggcttcaatagttcagcgtggggcattgcgtcagtgctggcaccgctgattggtggactaattgttgataagctcagctggcattggattttcttcattaatgtgccagttgggttgatcacccttttcctatttcaattttatttacgagaacccaaacgtcacaataacgtgaaaatcgactacttgggtagcttttggctgatgctcttcttgctgtgcttgatgctaagcttccaactattgggaaacgccactatcagttgggtggccgttgggactgcttggatcattagtgcgctcagtttgtggctatttattcgtcgtgaaagtcgcacggatgaaccagtgatttcgatggatttattcaaaaaccacacgtttattattcagaatgccgtggcggccttagtcagtggtttcctaatggccgttgaagtttatattccaacttggactcaggggatactgggtgtaccggcttctttggcgggattcgcagtgacaccgagctcgttaatgtggatcgtcgggtcattcgtgacgggtcggttattggcaaagtgggcgccgcgacggattttgtatctgagtttggctttcatcctcgtgacaagcatttgcttagcgtggttgccagttaatactgctttcccatggttcttcctgatcacagcgattggtggcgtgggcttcggaattacaattacagcaacgaccgtcacgtcgcaacaccttgtgccagctgagaacgtgggcgtcgcaacgtccttcaatacgttgagtcgaacgattggccaaacgttgatgatttcaatctttggaattgcgttgaacgttgggatgaaccaaggtattcaacaccatgcaggaacgaacatggcgatgatgaacaagttgatcaatccacagacagcaacgcaattaccgtctcatttgttgccgacacttcatcgtatcttatatacgggcttacattgggtctacctgattggccttggtttggttattctagcctttattgtgaatagtttggatcgcggaccacaaaaaacggcagcacaacacgcggctgatttaaaccaaaatcaggattagtcggcttagtatcaacaaattaattgtcaaagcgactcataatttgtcgtttatttgatattgacgtaaaaaaaatctgaaaaattttcaataaaatttccataagtgttataaataaattttaagttgttagacgagtgtaatgggctttatgaggcctattacactcgttttcattaatattatttatttggtaactattttaggaaaattaatggaaaacgtgtaacaagattgacggtatcaactattgccaacaaaacataatcatagtattatgagtgcatagcctaacgattgatggtgtataccaatgatgctatatatgtgttttttgtatcatatataaacgggtttgattaggttagagaaggaaggcaaaaccatgaaatttctgagacataaatcttttaggggagatccgaaagttcactacaagatgtttaaagtcggccgtacttgggtatttacggcgatggcatcatttgtattgactgctgcacctcagttagtatctcatgcagatacggtttcggcggatactagtagcgatacggcaagtagtgccactagtagtgccagctcgggggcggatacgtcttctgcagcagcgagtgcggcggcactagctgctgcaacggcaagtagtacgtcaactagtactaccagtgactcgtctacggcatcttcttcgagtgaaactgtctcgaacagtaattccgaatcttcatcgtatagttcaagcagcgatgacagtgcttcagacgcaagttctgcgagcgaaacaagtacgactaatgcgacaagtacatcaagtactagtagtagcagtgtttcaacggctagttcgagcgcatccagcgcaagttcaagtagtagttcgagctcgtcaagcgctacttcatcgagtttaactgatagcagcagttcttccgcagctagctcaagtacgacgagtttgtcaagcagtgctagcgtagcggcaagtactgtctcgacagcaagcagtgttgccagcacgactaagtctgcaagtacggcggcttcaacggcagccgttgcagcttactcgtcggtatcggctgccagctcacataccgatagtaccgcagctaaggcggcttcatcatcagcttcattagctggttcatacgccacacttgccagcagctatgctagtttggtcaataacctaacgacgcaagcagcagtgagtgcggcccaaagtgcctatcaagaagcgcttaacgcggctgatttgtcacggcactacaatagtattggaaacatgtacttagacgcattgacaaatggtgtggggtccaatgttgataatgcaatcgcatactctggtgcaaactctttagcatatagtgcagcgagtgcggccagttcatacgcagccctggcttcaacggccacctcaacggccagcagtgctgctacccaaggcttaattaatttagcaagtagcaattattccgccgcatctagtgcggcatctgcagccacggtagcagccagctcggcagctgaagcagccaacagtgcatacttagccatgcaatacgacaaaaataatacggccgttacctcagcttacaccgttgcttctagcacggcagctgcggcttcaatggccgcggttaacgcaacgaccgctgcggtggcagcttcctcagcctatgccgctgtaagtagtaatgcggcaaataatgactatgaagccactagtactgcctatgcagttacttcttccgccgcaacggaagcgcttggtcaatatgccgccgggagcaccgctactagcaccgctagttcggcagccagttttgccaacagtactgcaattagtgatttggcgagtgcggcttcttcaagtgcaaacgtggcgaatacagcaaatagtacggcttcaagtgcggccagtgtggcagcaacgcaaactggtactcaagcgtcagcttatgcttcaagtgctgcaacggccgctagctctgcttcatcagcctacgccgtcgcaagtacggctgcgaaatccgctgtcagtgctagtgatcctgccaccgcggactcatacgctcgggtggcccaatcggcatcttcattggctgctagttacgctgcaaatgccgagtctaacgcgactttagctgctaagttttcgacggatgtcgctaatgaacaaactgacagcaagaatgcaacgttaacgacatccacaactacgcctagtgtatctgtgggtagtacgattagtattactaatagtctcagtggtacaggtttgggatcggccacgtatacttggtatgtctctacggatggtactacttggaccacggtttcaggtgcaacttcggcaacatattcgacaacaccaacaatttctggtacgtactattatcaggcggtcgcttcagggtcgtatctgcttgtttcgacttataaagcggctggtaatgtgattatcattgttgttaccaatccagaagggacctacgctgaaattgccagcagttatgccagccaagccaacagcgcagcctcagtggcaacctctcaagccgccgctgcaagtagtgcaatcagtttggccagttcttcagctaacttgacgggctcattagctagctactacacatcacaggctaattcttcatacaacgcagctagctcatatgcgagtgtggcttcggaagcagcaagtattgcaactatggccagtacttcggccgcttcttatgaagccgaaggggcgtatactagtgctaatatctgggcaggaatggcatcgagttatgcgagtgttgcaaccgaatatgctagttctgcaagtagtgcggcatctgaggcagcagctagtctcgatactgctttgaaaaatgcggttaatgaagatggtggtgataccgcggctgattatttagcatcaagttatgctagtatggctgcgtcatcggcaaatgtggccggtgaccaagcctcgctagctgcatcctatgcggccaacgctgctaatgcatataacgttgctggttcttcatttaataccactgcaactagcagttataatgcagcggcaagttctgcggctgtagcggctagttcatacgcagcggcagctagtgaagcggcaagccttgctgcttcatatgcagcggacgggaattataattcggctgccttgcaacaaagctacgcggctttgcgtttgacttatgcaacagatcaattgaatgctgcttcgagtgcggcgagtgcgattacccaaacggttgtgcaagcacaatcaagttattataattcgattgcaacggccgcttctagcgcagcgtcagcagctgaatcggcagccgggaacgcaatcagtgtcgcaagttcattaagtgcaaagtatgcgtcaaacactacgttgggtagctcatacgttgcacaaactaataattatgccgtgacaactctgggtgcagcggcggccgcaacttcagctgcggaaatggcagctcagtatacaagccaggcttcatcggcagtagctgcgggcgattatgctatggccagctcatatgtgaccaatgcctcagcagcagctagtgaagcaacctcatatgcggcattgtctacatccaatgcggctttaggtagtacggcggctagcaacgcgacgaattattcaaacaatacgaattcatataaaagcactaatacgggtaatgcaacgacaattctcgggattgttatttctggtgggatgacttctcaacccgcagcagtgacgtcgaccgtttctggtgggacctttaccttgtcagcttcgtcagcattaggactaggtggggttgcactatcatcaaaaacaacttggtatgttcaagtcaacggcacctggatgaccttagataaggccagcaattatcttgaatcgtattcccaaagtgacaatgctggtttactgtcaactagtagttcattaacagttactatcaaagcgggctatactggatcattgctgttccaagccgtacaagggttttcttgggacttggcaaactggcttacagtttatacgtttgcaagtaatttagcggaagtagatgtttatagtagcaatattccagcaacaaacatttccatagctggtgatgattacgtcattaatccaacgaacagttcgagtggctcaaacgataaggttactagccagtttacatcaacgactaaccctgagaatgctacgggaacgattagctggacgacaagtgattcaagcattgcgacaattgatgattctggccttttgaccgttgtgtctaatggaacggtgaccatcacagcaacaattacaaatgcagacggaactagctattcatcttcaaagacaattacaattggtagtggccttgaggatacgtctgttgatgcaggaagtgatttgacgtgggttccagatggttcgactacgggtactgggactaatgttacttatcaatggtattattcttcaacagcggacggtactggaacagcgctgagtggtcaaactggtacgacacttaatctgtcggatctgacagtagggcaatccggttattactacctagttattactggatccaatacgactaacgggactactaccacgacaactgtaactttaggccgggcttacttgactgttaatgctgtttcaactgaagcggcagattctgcagctagcgaagcatctaactacgcaaatcaagcgacggaatatggttcagttgctagttcttatgcgaacattgcgggcgaatatgcaagtaaaaactcagaagcaagctcctacgcagaacaagcaacggcagcagcttctgatgcacagtcagctgcaacagctgcttcaactgcagcctctaatgcggcagctgcccaatcaaatgcagattctgcggaagctgccggcgaaaactcggctgcttccagttatgcagaggaagctaaaaagaaagcgtccgaagcatctgaagctaaaaagaaagcttcaagtgccgctgatgatgcaggctactatgctgatttagctgctaatgttagtgaagatgactcggatagtgattctgacggcgacagtgattcggatagcgacagcgattccgactcagacagtgattcggactcggacagcgactcggactcggacagcgactccgacagtgattctgactccgatagcgacagtgactccgactcggacagcgattcagatagcgacagtgattcagactcagacagtgattcagactcggacagcgactcggattctgacagtgattccgactctgatagtgactcggattctgacagtgattccgactccgacagtgactcagactccgacagcgactcagattccgatagtgactcggattctgacagtgattctgactcggatagtgactctgattccgatagtgattccgattcggatagtgattcggattctgacagtgattcagactccgacagtgactcagactcggatagtgattcagactccgacagtgattccgactccgacagtgactcagactcggatagtgattcagactccgacagtgactcagactctgatagtgattcggattccgatagtgattccgattcggacagtgactctgattccgatagtgactcggattcagacagtgattccgactcagacagcgattcggactcagatagtgattcggattccgacagcgattcagatagcgacagtgattccgactcagacagtgattcggatagcgacagtgactccgattccgacagcgattcagactctgacagtgattccgattctgacagtgattccgactcggatagcgattctgactccgatagtgattcggatagcgacagtgattcggactccgacagcgattcggattcggatagtgattcagactcggacagcgactcggattcggatagtgattcagactcggacagtgattctgatagtgacagtgactcagactcggacagcgactcagattccgatagtgattctgactcggatagtgattcagattccgatagtgattccgattcggatagtgactcggattctgacagtgactcggattcggacagcgacagtgactccgactcggatagtgattctgactccgacagtgactcagactcggatagtgattcggattccgacagcgactccgattcggatagtgactcagactcagacagtgactcagattccgatagtgattctgactctgatagcgactccgattccgacagtgattcggatagcgacagcgactctgactccgatagtgactcagacagtgattcggattccgacagcgattcggattccgatagtgattcggatagcgacagtgactcagactccgatagtgactcagacagtgattcggactcagacagcgattcggattccgatagtgattcagactccgacagcgattcggattcggatagtgattccgactcggacagcgactcagactctgacagtgattcagattccgacagcgattcagactccgacagcgattcggattcggatagtgattccgactcggacagcgactcagactctgacagtgattcagattccgacagcgattcagactctgatagtgattccgactccgacagcgactcagattcggatagtgattcggactccgacagcgactcagattcggatagtgattctgactcggatagtgattcggacagcgactcagattccgatagtgattcggactccgacagcgattcggattccgatagtgattcggactccgacagcgactcggattccgatagtgattccgactcggacagcgactcggattccgatagtgattcggactccgacagcgactcggattccgatagtgattccgactcagacagtgattctgatagtgacagtgactcagactcggacagcgactcagactcggacagcgactcagattccgatagtgattcggactcggatagtgattcagattccgatagtgattcggactccgacagcgattcggattcggatagcgacagtgattcagactcagactctgatagtgattcggattcggatagcgacagtgactccgacagtgattctgactcggatagtgactcggattctgacagtgattccgactccgacagtgactcagactccgacagtgactcggattctgacagtgattccgactcggatagtgactcggattctgacagtgattccgactccgacagtgactcagactccgacagcgactcagattctgacagcgattctgattcggatagcgactcagattcggatagcgacagtgactcagattccgatagtgactcggattctgacagtgattctgactcggatagtgactctgattccgattccgatagtgattccgattcggatagtgattcggattctgacagtgattccgactccgacagtgactcagactcggatagtgattctgactccgacagtgactcagactctgatagtgattcggattccgatagtgattccgattcggacagtgactctgattccgatagtgactcggactcagacagtgattccgactcagatagtgattcggattccgacagcgattcagatagcgacagtgattccgactcagacagtgattcggatagcgacagcgattcggattcggatagtgattcagattccgactcggacagcgactccgactcagacagtgattcggatagcgacagtgattcggactcggatagtgattcagatagcgacagcgattccgactctgatagcgattccgattccgatagtgactcagactcagacagtgattccgactccgatagcgactccgattccgatagtgattcggattccgatagcgacagtgactcagatactgacagtgattctgactcggatagtgattcggacagcgactcagattccgatagtaattcagactctgatagcgactccgattccgacagcgattccgattcggacagtgattcggatagcgacagtgactcagactctgatagtgattccgattctgactccgacagcgattcagactcagatagtgactccgattccgacagcgattcagactcggacagtgattcggatagcgacagcgactcagactcggacagtgactcagatagcgacagcaattccgattctgacagcgactcagactctgatagtgattctgactcagacagtgattcggatagcgacagcgattcggattccgatagtgattccgactcagacagtgattccgattccgacagcgattcagactctgatagtgattccgattctgacagtgattcggatagcgacagcgactcagactccgacagcgattcagatagcgacagtgattcggactcggatagtgattctgattccgacagcgactcagattctgacagtgattcggattcggatagcgattccgattccgacagtgactccgactcggatagtgattcggactctgacagtgattccgattctgacagtgattccgactcggatagcgattctgactccgatagtgactcagattcggatagtgattccgactcagacagcaattccgattctgactccgattctgacagcgattcggatagcgacagtgattcggactcggacagcgattcggactcggacagcgattcggactcggacagcgattcggactcggacagcgattcggactcggatagtgattctgattccgacagcgactcggattccgacagtgattcggactcggatagtgattcggattccgacagtgactcggactcagatagtgattcagattccgacagtgactcggactcagatagtgattccgactcagacagcgattcggactcggatagtgattctgattccgacagtgaatccgattcggacagtgacgctgactcagacagcgactcaggttccgacaacgactcagactctgacagtgattcgaatagcgacagtgactccgatacaatcacagattcagattcaaatgatggaaccaattctggcaatggtagtaattctggctcagatggaagttccagttcaaatactggatcaggttcgggcaatacgacgggctctactggaaataactcaggtactggcactggtacgacaacttcatcgactgcttctagcaacggtgctgcttcgacaagtacgactagctttagtgctgcagcaacaagtggcgtctcggccacagccgcaacgttggcggttacgacaccatccaatgacggtgctgcaacaacgtcagcaactgctgctacatcagtggtttatgccgctgctagcgctcaagacgttgatgcaacttctgatcagactgattcagattcgaagagtagtaatgattctgataaggataagaagtcagctgatactgatagtgctgatgataaggttggctcaagtaatactgacgagaatggtaagactgcatctgatacaagtaataatgccggaacgattttcggtggcttgttgaccgcggctgcagctgctggactcggctggtggttcttcttgttcggtcgtcgtcgtaaagatgatgatgaagatgacgagaatcaaaaatagttaaaatttaaagctgatttgttagtactgctaacgatatacgttgtaaaataagactattaaccaaaacgggcgtgaagcccgttttggcgtacataaaagaaaattgaaagaggtaagactaagatgcaaaaatctactgtcaccaagcttaagcaagcactgattgcaactggaaatttgaaagattacggtacaagtaccgtaaccttggcactttcggtatcggatcatcgacatcgggcctaagtgcgattctatcgttgcgattctttcaagcaagcttggatagcagttgcacaacaattagccaaaacccctcaagcgagttgggttcgattagaagcagttcaatcaacacagaagttaccaagagaaacttttgaaaagcgattggcagctacttttcggatgaactattggcgatacggtattagttttgatgcagatttcaagacagccttattggagatggaaagtaatggacaagcatttttccgtcctagcaaagcgcatcgaattggtaagaatcgttcgggttcttgggtcgactatgatcgagtagagccgtatcttaacaagcgtgaaggagcgctaccagtcgatattcgaaagacagaaaatgtttgggtctttacaaccgctggtgtatttactgacgggcagaaaatctggaatctatctgagcaagaggattgtggtaagggcgttcgggtggtgactaacgagcagagcgagctgcaatcagctattgaacatggtgaaactttcctaattaatcagttaaaaggcaatggaaaatttgtctacggttattttccggctcgtcaaagagttcttagcaattacaatgttgtgcggcatttttcgtccttatatgccttgctggaagccattccattcacaaagcgtactgaagattttgcaaaagttaagttagcgattcagtggggcttaaaaaatgccacgattgaaaaagagggcgcaatcttcgtcgatgataatggcgagctaaagttgggtggacaggccttgttaatacttgcattgagtaagtatcaagacgttaccaaggatgatactttcgtgccagttttaatgaaagcttttaaaggcgtccatttcttccaagaaccgtctggtaagttaattcatgtcctaaatccagatttaacggtcaaagcagcttatcgaattatctattatgaaggagaagtcgcatttgcgctttcccgactatatgagttaacacatgataagaatgtgatggatctggtgaagcaaatcttggattacatggtggctaatgactacggtaaataccatgatcactggatttcttatgcaatcaatgaagcattactggtattctcagacaatcgtgattatatgaaactgggtttgaaaaatgtattcagtcatctaaaattcattgaagagcgtgataccacgtatccaacattacttgagttagttgatgcggccgtcaaaatgaccgatatgattaaacgttcaggtaatgaagacttgatagcaccttatgacttggttcgtttacggcaggtattgcggtatcgtgcgttgtatgagattactactgggtgttttctacctgagattgcaatgtatctctataatccacagaagttcattggtgggttctatgcacgtcatgataatttccggacacggattgacgattgtgaacacttcttatctgggttgatcaactattataactacacatatcgacaagcataatactaggtaacagaaagggtgactgtatgttttacttcattaatgaatatattttaggcaagaattcgagtgttgagcatgcggcaatcaaccgggtgaaattatttaaccactataaagcgccagcccagattgtgactaagatgtatgaccgtttgctacatcagaccatgggaacttttcagttagcaaaccagcaagtgctgaatatgtttgattactttcaacaaaccacggatgtgccaactaaagttctgcatactgatgacatgcatctgccagttgaatatgcggtagaagtgggtgccaactttagcaaaatttttaatggtgatgaacacgttagcaacgtcggctttattcctggaacgattgggcgcgtcttttaccaagaattcttcgacaatcaaggtaacttatcttcaactgacctgtgggattggcgaggcttcaagtccagtacacaatattttggtcagaacggtaaactggttttggaacggttttataatctacaaggcgagaccgttattgagcagtactatgtacctgacactaacggtaatccgctagcgtcacgtttgattttaaagaattatcgtgatcaagcagagcgcttcttccaggacgcgaaccatttatttcgtttcttcttggccgaactcagtcatttggacaagcaaacgacgacctttattagtgatcgcccaggtaccagtgtgaagccgttgttggaacttcaggatgattctcacaagtatgtgacggttccaatttatcaggcgaaggatattaatgacccaattcattccccgttggacgggttcttaacaccggccttcgataatctgcaacactttgatggtttcattacagctactgaaagtcaggctcagcatctgcggacgcggttccctaaagctaaggtgacagtgttaccaactgtaactacgagtccgttggcgcagagtaaactacggccaatcacggcccgccccaagcaattgctatacgttgggcggctggcgccggatcggcaactggatcagttaattcggaccattgcgttagttaagcaacaggtcaaagaaattcagtgtgacttttacggctacggcgatccagagtatcttaagacgctgaataagctggttgaagaattaaaattgacgaataatgtgtatttattagattatcatcctgatttagaaacacgttatgatgattatcagctgttgctcaataccgatattgttgatggtggtccaatgggtatgccggaagccatgagtcacggaattccagtgattagttatcgctttaattatgggcctaaagattggattgatgacggtcatgacggtttcatcgttgatcctggcaatcaattggcgctgcgtgaccgggtcatcgaattaatgacggatacgaagaagttgacggcattcagcgaagccgcctttaagaagcttcatacgtcacaaactgacttaaaagtttggcaccgttggcaacaattactgggtattaagtaggagggcgcatatgtattatttcttaaacgataacatgcaattttcaaaatcaggaatcgaacaggcggaaatcaaccgactgactttattcaagaagcaccatgtggctgctaaaatcgtgacccgcgtattcgcaatgaacttgcacgatgtgcttgaaggggccaacattgccgatgctgattttgttaatctttttgacttcttttgtggtagtcagtcggtcaagcgtcaaaggtttgatttggccgactttgaagtgccagccgatgctatcaaaacccggaaggataatcagattcaagtcatggaacgtggtaagttaatcatgattatttaccttcgggccggtacggaagccgttagcaatgtgcaatactttgacgttaatggtcgtacgctcaagatgagttggtgggatacacggggttttaagtgtcttgaacaattatttgattgggacggtaagattgcccaagaagcgtactttggcccggatggattgattcacgtggagaagttacacttgttaaatcacgctggtcaggagcgaatcacgtggcgcgtcttgaactacaacgagcagagccatacttttaatgggatgaatgaactgacccgttacttctatgatgaacttaaccagttgaatgatgaacaaaatgtcttcatttgtgatcggaccgtcgaatgtgcctggggcttattcaatatgaccacatcagctaagaaagtcttgcatctacataataaccatgtgagtgatgctaaggatattatgcattctaccttgaacaataactatgctaatgcgctgaataattgggcggcttgggacgcggtcatttctgcgacaccagaacaaactaaggacgtggaagcccgctttggtaaggatattccagcgttcactattccggttggctatgttgataatgctacgttaaaagccgcgccggtgaagtttgaccaacgacaaaaagacctcgtcgtgcaagttgcgcggctggcacctgaaaagcaacagaatcattcaatcgaagcctttgttgaagttcacaagcattttcctgatgccaagttggaattatggggttatgcgaacggggatattgaaaagcaactacatgcacaagttgctgcagcgcacttggaagatgtggtattgttcaaggggtataccacggatgtcaatgccgtttacaaccgggcccaattaggacttttgccaagtcgagctgaaggattctcattgatgttgctagaagctcaagcccatgggttaccaatggttgctaatgacgtgaagtacggcccgagtgatattattcaggatcataagagtggaatcctaacgacagacggcgatgtgcaacaattgaccaaaacgattttagaattgttgaagaatcaagggcagctggcacaatacagtgctcaggcctatgaaaatgccaagcgttattcagaagaagccgttttcaaacagtggcaagcattgttagattactttaagcctgctaaggtcacggcttaagtagatttgacggcaagggaggacgcaaaatgttaatgattatgaccatttatgggaccgttaagatgtttacccgaatgatcgtgtactgtggcatcggtggtcttgtcctaattgttcgtcaccataatcgtaagaagcggcgtaacgagatggacgagggaactaagcggatcatgcgtaatacccctaaggatgagaacggtaagtatccgtgggagaagtaaggtaccattggtttttaagttaagtatctaattgaaaagacctgtcagacgaagctaatcgtctgacaggtcttttcggctaatttatcgttaaattaacgtttctgaatggccaacaaatatggcggcacatagacttgattaataaactgatattgtaggacttggaattgatgctggtctaaattcgttacgtaatccaaaacggcttgtgcttctgtcgcaccaccgggatgaccagcatagactagcaggataatgagtccgttggtgacgaggcgttcctgaatggcttttatggccgttaacgttgtcgttggtttcgtaatgatttgtttatcgccacctggtaaatagcccaggttaaagacggcacacttgataggttgatcagcggcaatcttatctgcgatgtgttcatggcccgtttgccacagagtgacttgatgggtgagcgctgctttatctaaggcagttgtcgtcgcttcaatggccgctgattgaatgtcgaacccgtcgacgtgaccagtagtcccgaccagcttggcgaggtagacggtatcatggccgttgccaaccgtcgcgtcaatcacatggtcaccgggattgacgacttggttcattagcgcgtggctataagctaatgccgaactgagttgaatgagtgttacccccttgttgaattcatgaattagggccgcaatcgaagcggtccgtgccgataacgcgtactaaaacgcgcacttatatatagtaaaacacttccaagtaaaaggccaccgattgtatcgctgggatagtggacgcccacgatgacccggctgatcatcattaacaagatggccgttatgccgagggcagtgagccagccagtcaaggcattgcggtgccagtagtcaaatgccaacacgagcagactaccgataaggacggtcgttgttgtcgagtgcccgctggggtaactataccccccaatttggacaagtcgccaagcggttggccgtggccgcatgatgacctgtttgatgagataattaccgtagccggcaatcagccaggtggtgacccaaaagaagactgcgccgcgtgggttatggcccagccagagtgccaggccgataatcaacgtgattatggtgatggtgtggggattgccaagctgcgtatacgtgaccatcgcgtgttgaaaccactggggactatgatgccaaaaattagcaaccgtggtatcaaagtgtgttaaccaaggcgcccgttgccataccgcggccgtccagcctaaccagcctataaatataagtagaatcaaactgtccgaacgttgccaggatcgttgcttcaatactgattcctccgataaataaattattgacattattatagcattttttatcaggggtccgattaatgccgatgataaaatttatcgccagcggggcttggacccttgaaaaaaacgtgctggtttgctactatgaaaacaataactttacgactctgagaaggaatagtagtggctggtgttttgcagaaactccgtggtagttgcaaacggggattcaccaatcatgaactcaccttcgagtcttccggctgaacaagattgtaggtacggacgtggtttcgcgttaagattcccaagaggccacggtaacgtggaatcataggtggtaccgcggaacccgttttcgtcctataagcttaattggcttataggatttttttgttttttaaccgcttttactgagttgaagcatgaaaatgccatcttgaatagtcagttggaaagtcgcaatgctagcttttacatacaaggcagcaagaaaggggcactactatggcatacaaccataaagtcattgaacgcaaatggcaacattattggaaggaaaacaaaaccttcaaaacattagatacgacggataagaagaagtattacgccttagacatgttcccatacccatctggtcaaggattacacgttggacatcctgaagggtatacggccacggatattatgtcacggttcaagcggatgcaagggtacaatgtcttacatccaatgggttgggacgcattcggtttacccgctgaacaatatgcgctcaagacggggcataacccgaaggactttacggccaagaacatcaaaaacttcaaacgtcagattcggtcattaggtttttcatatgactgggaccgtgaagtgaatacgactgatccaagttactacaagtggacgcagtggatctttgaacagctctataagaagggcttggcttacgaatctgaaacgttggtcaactgggctcctgatatgatgggtggaacggttgtttctaacgaagaagtggttgatggtaagacggaacgcggtggctatgatgtttaccgggtgccaatgaagcaatggagcctcaaaatcacggcctatgcggaccggttgattgatgacctggacgatattgattggccagaaaacatcaaagagcaacaacgtaactggattggccgctcagttggcgcatccattcgtttcaaggttgctggtcaacctgacgataccgagattgaagtgttctcaacgcggccagacacgctgtttggcgcaagttacatggtcttggcacctgaacacgacttagttgaacaattgacgacacccgaacaagcggacgctatcaaagcatacaaagctaaaatcgccagcaagtcagaccttgaacggactgatttgaataagaacaagaccggggtcttcactggtagctacggcatcaacccggttaatggtgaaaaactgccaatctggattgccgattacgttctggcttcatatggaactggggccatcatggcagtgcctgctcatgatgatcgggactttgaatttgcacaaaaatttgatttgccaatcaaacctgtcattgcgggtgataatgattatgaccaacaagcttacactggcgacggggaacacatcaactcaggttttgttgacggtttagctaagcaaccagctattgataagatgattgactggttaggtgaacatcatgccggtgaaaagaaggtcaactatcggttacgtgattggatcttctcacggcaacggtactggggcgaaccgattccagttattcactgggaagacggcgaaacgacgctggttcctgaagatgaactaccattgcggttaccagcaactaagaacctggaaccatcaggaactggtgaaagcccgttagcgaatatcgacgactgggtaaatgtcgtcgatgaaaacggtcgtaaggggaagcgtgaaaccaacacgatgccacaatgggccgggagttcatggtacttcttgcgttacgttgatccgcacaaccgtgaagctttggccgattatgacaagttgaagtactggtcacccgttgacttatacgtgggcggtgcagaacacgcggtcttacatctgctttacgcacgtttctggcacaagttcttatatgacttaggcgttgtgccaaccaaggaaccattccagaagttagttaaccaagggatgattttgggtgataatcacgaaaagatgtctaagtcgcgggggaacgtggtgaaccccgatgatattgttgaccaatatggtgccgatacgttgcggttatacgaaatgttcatgggaccattggaagcttcgattccgtggagtaccgatgggttacatggcgccaataagtggatcgaacgggtttggcgcttaatgatcgatgaaaacaatcgtgttcgcgaccgaatcacgaccatcaatgatggtaagttgacgaaaatctacaacgaaaccgttaagaaagtcacggaagactatgaagctatgcgctttaacattgcgatttcgcaaatgatggtcttcgtaaacgaagcatacaaggtcgacgatttaccaatcatttatatcgaaggctttgtgaagttactgtcaccgattgcaccacatttgtcggaagaactatggtcattattaggccatgatgacacgatcacctacgccacttggccaacgtatgacgaatctaagttagtagaagacacggtccaaatcgtgcttcaagttaatggtaaggttcgctcgcacgccgaagtcgctaaggatatgggcaaggatgaacttgaaaaactagccctggcggatgaaaaaatccaggaatttacggccggcaagacagttcgtaaagtgattgccattcctggtaaactggttaacgtggttgccaactaagtaccacgaccagtatcaacttaaatgaatatcgcttaaattaatcgtgatggtgactgacaattgttggttgctatcacgattttttaactactcacagaactaattagtgcggttacgattgatttggttaagtgaataaagattctggggacgttctggttcggtttgggagacaaatcacacgtgtttttggtgggcagggcgtgtgcaaccgcctatgcttaacttaaaactagtagtaacgtggtttaatcatcggaaatggttatcatggcggcactctgctgtaatcgaatttgggactgcatcatgcccgctggtaaagcgtacggattggtcttttttctgtatcagctatagggtatcggatggcggtacggttcgccaatagctggtgcagttgtcaagaccttatcattaaagttcggttaaactcacgcataaggccggaattgaattgcaacttgtttgtttttcatctaaaatgattaggattgaattaagaaagtgggttacgaacatgtctgaggaatcaaaagctaatcagccccagaatgcacacgtgaattctgaagccgaagcgcaccagaagatggtgcgcgggtcggcttggatgacggctgggagtctcttttcacgggtgctcggggcgatttatattatcccgtgggttatctggatgggcgctgattatacgcaaggtaacgctctttatgccaagggatataatatttatagttttttcctgctaattgcgatcgggggaattccgtccgcaatttctaaacaactttccgaatataatgcgatgaatgaatatgccgttggacagcgcttgttcaagcggggcttgttgttgacgtcagcctttgggattattggtgccattattttatggtttggtgctggcttgatttcaacagcttttgggggctatgatgccaatctgattcccgtcttgcatgcgttggctattgccttggtgattctgccatcgatgtctttgacccggggattcttccaagggtatcaacagatggcgccgtccgcaatctcacagttcgtggaacaagtctttcgggtcatctatatgttgggtgcgacgtatttcatcatgcgcgtcgctcacggcgattgggtgaatgccgtgacccaatcgacattcgcagcattcgtcggggcggctgccagcttcttattactcggttggtattatttccgcaaacggtccgagctaaatgccttagctgctcagagtgagaacaaactagttattccagtctggcaattgttccgcgatattattattcaggcgattccatttattgtgatcgataccgcgacgacagtcttcaacctgttggatcaagcaacgttccaaccgatgatgcggctggtttaccatttgggtactaagcagatcgatacgttgtatgcttactttgcatttaatgcgaacaaattggtgatgatcattgtgtcattggcgtctgcgattgccgtgacggtcgtgccgattttatctgaatcattggccagtcataatatgcgtaatattcgtaaacaattggaagattcgattattttattcctatttatcatgattcccggagcgctggggatggccgcagtggcacaaccacttaacacgctcttttatagttatgatcaaattggaacgttgattctgcagatctcagcatttaccgcgattgctttaggcttttttacggtgatttcggcgctgatgcaaggcctatcacgcaaccgtgatattattcgctattacttgatcggcttactggtcaaaatcgtgattcagttaccatgtatctatttcctatcaacggctgggcccctggttgcgaccgcgattgggatgatggttgcgagtctgatggcgatgtatgatttggaagtcaactttggaattcgttacgtgaagttattaccaaaaatcaatcgaattttagtttattcgattttaacatacgtcacggcacgattagttgtttatgggctgaactttgtgttgaatgagcacagtaagacgcaatcgttcttgatcgtggccctagcagttatcgctggtggtgcggtttacgtttacttagcactccgttcacggatggctgatttgatgattggaacgaaagctgctgggttacgacggaaattacggattaaataggtgaattatgcgagtagataaatttttacatgcgatgcgaattggcacgcggactcaagtacgtcgtctgattaaagatggtcatatcactgccaatggtgagccagtaatctctggcaaacaacagattaaccctggcagtgataccgtctttttagatgacgtgcaggtccgttaccaacaatacttctattatgtgatgaataagccagtcggggtcatcacggcaacgacggattccgctgcgaaaacggtgatggacctgttcaatacgacggattttcgtgacgatctatttcccgtgggtcgtctcgataaagatactgagggaatcttggtcattacgaacgatggggccctatcacacgacctattgtcgccgaaccaccatgttacgaaggtctatgaggctgaagtaacgggggaaatcactgcagctcaattggctaattttaatgatggaatcacgttaaaggacgggactgaattgcaaccggctcaggctgagattgttcaattccatgaaatcgagaactttaccacgattcgaatcatgatccatgaaggcaagtatcaccaagttaagcggatggtcggaacgttaggtgaacgggtcgtcgggttacggcgaatcaagtttggttcgttaacgctacccgttggcttattagcggggaactatcgtgcgctgactgatgacgaactaacagcgttgaaggcggatgcgaaccaacccgtaggcgaatagtgcgtgttacgaattcggccactctggtttaaactaaatcattaagccccaactaactatgaattcaagcatggttagttgaggcttttttagcataatgtcgttggcttgttcgtgttcattatggtccagctagctaagggcgttcaatctgactaaagcggtgcatgtaagtcggaatgcgggtactgatttgatgcggcaagacgacgtaccgcgttgcagcgaggtcatcggcaatggcactgtgcaagtagaccgcgctgagaacggcatcggtgaaattatgaaattgacttacgaagccaccaatcataccagccaacgtgtcacccatgccgccggtcgccatggccggagtgccgccggggttgaaccagactcgttcgtcagtgtagacggtcgtgcgatgagctttgaccacggccgtaacacctaaccgttgttgcgcgtcatgattggcagttggggtttgatctttgatcgcgataccgctaagtcgttgccattccatttggtgtggcgtgaccacgatgtccgtggcgggtaaggggcgggactgctgtgcaagcaaggtcagcgccgaaccatcgatgaccaatcgttgtgggacgtgcgtcgcagcgagaacggcggtcagtaactgatcagcgacggtatctgttccaaggcctggaccgatgacgataacgtccattcctgccagcaggtttaataaggtgtccgtttggtgatagtcaatgaccatggtttcgggtagccgagcatgtagactcgtgaaattagacgggtcggtagcgaccgtcaccagaccggcaccactatatgttgcggccgttgcggccatgatgatagcaccaccaaaattttgattacccccaatcagcatgattcggccgtaattgcctttgtgagaatcagccggtcgtttgataatcgttcggctaacaatttcggttgtaataggttgcataaaatgaccagctttctaagttaatttactttgagtataccattttccaaaagcggttacttacgattattaagttgacgacagctatgataaaattaaggtaacaatatgtgggaggaatttaacatgtcagttgattggaaaaatgaagcaactaagcatcaagatgattatttagcagatttaaccaccatgctccgcgtaccgagctttcgtgacgatagccaggcgacggatgatgcacccttaggccctggtcctaagcaagcgttaaccacgtttttagcgattgcggaacgcgatggctttaagaccaagaacattgataacttggtcggttatgctgaaattggtgagggggatgaaaccttggcaattttagcccatgtggatgagatgcctgctggtaatggctgggatacggaccccttcgaaccaaccatcaaggatggcaagatgtatgcccgcggcgtttccgacgacaaaggcccgggaatggcggcctactatggcttaaagattgtcaaagaacttggcttgaagctcaataagaagattcgctttatcgtcgggaccgatgaggaaagtaattggactggaatgaaacgctactttgaagttgaaccagcgccaaccttgggcttctctccagatgccatgttcccgctgatcaatggtgaaaagggaaatgtgagtctgcaattacacttcggtcatgaagataatggcgactttaaccttgtttcctttgattctggtttgcgtgagaatatggtgccgcgtgatgccgaagccgtggtcgcaacggatgacaacgagcagttggcggccgacttcacagcgttcttggaccagcaaccagtaactggtgaattaacggtcgttcctgaaggcgttaagctggaagttgttggaaaggccgcccatgggatggaaccacgtaacgggatcaatgccggaacctaccttgcaacgttcttgactaactatgcctttgctgatgatgccgctgctttcttagacttcgtggctaataagctacacgatgattcacgggcgaaccagttaggcttagcttacaaggatgacgttatgggtgatttgacgatgaatgtcgggttactcagcttcgaccatcaaaagggtggtgcgttaacgttgaacttccgttatccgaagggaatcgaacctgctgatttaacggcgaaagtccaagcgcagttaccagctggtgccacggtcacgcagggtgacttcatggtgccacattacgttgaccctgaagacccgatcgtcaaggatttgatggacgtttaccggcgtcaaactggtgacacggcctcacaaccacaaattgttggtggtgggacttatggccggatgatggctcgtggggttgcctttggggcactcttcccagataccgaagatacgatgcaccaagccaatgaattccaaccaattgacgaattaatggctgcaatggcgatttacgctgaatcaattgccgtgttagcaaccgacaaatagtaatcctttaatggagggtgatggttatgacgatggttaaacgcattttagtcggcatcgatacgagtcctcagtcccaattagctttaacgaaagcaattaagatcgcggtcgagcaaaatgccgctttggatattgtgacggtcattaatactgagaaatttattggtgtgactcaagggccgatgggttttggcgcaacgacaccgcaggcattgaacgaattgacggccggtcttaaagcgaatctcgctaaggcccgccaacaagcgatggccgcgggtgtcagcgatgtgcgggttcacttacattcaggtaattcgaagttattgttagcgacgactttaccagaccgctatggcactgacttgatcgttgttggggccacaggtcttaacaacgtggcacgggtgttaattggctctaatgctgcttatgtgattcgcaatgctacctgtgacacgttggtggtgcgcacagatgctgatcaacagccagtcaaactgccaaagcataccactcgtcggctttaattgaaatttttaggacatccgatagtgtccggataaacatttgagcggctttttcaagctcgatatcggacacagagaaaaccgactcacggtggaccgttatcatccatgacagattaactggtaggacacagactaaatagttgtttcgagaatgtacaaattcttgaaacaactattttttattcactccgaatttgttggtggggcgctgtttatgaaaaaaatacataacccatacgttatttttacattatgccaacattcccgatacgttggtctggcatgattaaagagtaatctaataaattacaaataaaaggtcgaggggatatgaatatgggaattaccttgcagaacatcacaaagacgtatgataaggcgaaacagccagttttaaacgatgtaaatgctgagattcaagacggggagttattcgtgattgttgggccatccggttgtggtaaaagtacgctgctgcggatgattgccggtattattccaattactagtggaaagctggccatcaatggtcagatcatgaatgcagtcccaccaaaagatcgaaagctgtcaatggtttttcaaagttatgccttgtacccttttttggacgtggctgccaacgttgcgtttggtttacaagcacgaaaaatgccggccgcggaagtcgagcgtcgggtcaataccgcgttgaagatggtcaatttgacggcttatcgtgaccgcaagccgcgcgaactatctggtggtcaaaggcaacgagtggctttggctcgggcgattgccagtgatgctaaggtttgcctgatggacgaaccgttatcaaaccttgatgcgcaactacgcgtgcgaatgcggaccgaaattcgcgaactgcaacgtaagctcggattgacattgatttatgtcacccatgaccaaactgaagcgatgaccatggccgatcacgtaatggtgttaaatgagcgtcacgtgcagcagattgatacaccgttagatatttataatcatcctgctaatcatttcgtcgctgaattcttcggtacgccacagattaatttactgccagtggtgacgaaaaccgctcgtaatttacacgtcgcggagggctttcagattgcgcttaaccaaccattaaacgcggggagctatacgattggtatccgacctaatcagctaaacgtagtaccagttactgatgagcgcggtaatggcaaggtcacgaatgtcgagacactgggcgagatgacgattatcgaattgcaggctgataacgggacggcattgcgagttgcacaatctggtcaggtccaattaccacttgaacaacgggtgaatgtaaccgttaatggtaagatcttcatttttgatgagcacgaacaactgattgctgaagaggagggtgttactagtgatcaactcgtttccgtcgattaagcgacgccttaagccgaaacaatcgccagatgcgcatgaccaagcaactgtgcagaccggcagttttgaattaaagcgtaatgataaatattatgcttggctatttcttgggccctcaatactcgccctcagtgtttttgttttctatccaatgttacgcaccttgtatctaagctttttcttgactaatagtcttggtgaaccaaccgtctttgttggtttgcaaaattaccttaatttgctgacgactaagagttatcttgctagcctgcaagccactggaatctatgtcgtgggtgtgacagtgttcacgttaattggggggttactgttagcggccgctgccaatcaaagggttcggggtatcgagctatttcgaactatgtttacctcgactgtgggagtgtctgtctcggtctccgcaattttctggttattcatgtttaatccatccgtgggcttgttgaataaggtggccatctggatgcacttaccggcaattaattggttaacggagccacactgggccatggtggcaattattatgacgagtgtttggatgcacctcggatttacttttctgatcttttttggggcattgcaagtcgtgcctaaaaccttatatgatgcggccgatgtggcggggaccagtcggcgttatcagttcatccatatcacgttgccgatgatttcccccacactcttctttgcggcggtgattacgttgatctcagcgttcaagagtttcggattgattgacttgatgactgcgggtgggcctacgaacgccaccaacttattagtttaccgtatttatcgggatgccttcgttgatggtaactatgcgcttgctagcacggaatcgatcatactagcaatcattattgcagcgattacggtaatccaattcaaacttttagcaaagcgggtgcattactaatggaaaatacgatggctactcaagccctgattcgacatcgaatcggtatcggattccggtacttgttattaattacattaacgttagtcattattttaccgtttgttttagggttgtggaccagctttttaccaacgacgactattgcgaaaggatcactgagcggaaccctttcttggcagaactatcaggatgcgtttaccaaaacccccattcttcgctacttatttaacagtttaatgatttcaatcattcagatgattgctcatctgttttttgcatcaattgccgcctacgcctttgtgtttttagaatttaagtatcgggatgcgttgttctacttggtcttggcaactatgatgctaccatttgaagctgaagtgattccgaactttcacacggtccgtgcgatgcacttgttgaatcactatgcggtgatggttatcccgttcttaacttcggcctttggtatcttcatgttacgtcaagcctttctgcaaattccgcgagacttaaaggaagccgctgatgttgatggtctctcacactggcaattttactgtcgcgttgccttaccatactcacggattagtttattgacgctagctgcttacagctttttaggaagctggaaccaatatttatggccaatgctgaccacgttttcaaatcggctacgtccggtccaagatggattgcagcaattgcattcggaagaaaccgctacgaattggggactcgttcaggcgagtgccgccatcgtggtgattccaacattgattgtccttttctgggggcaacactactttaaatctggattgaatgaaggttcggtgaaatgatgaagataacgcgaaagtggcagtggctagccggtatgatggttgtcctcttggtagtgggtggggtcgcttatagtcggacccgtgtccatgcggatagtagtcgcattaaagtggtgttttggcatgagatgaaaggtcctggtcaacaagcgattgacgcctacgttaaagcgtttaatcaccaacagtccaagtatgaagttgtagccgagtttgagggtggctataatggcgtcattcaaaaaatcttgaatacgcatgggacggccgcgtcaccagcgctatttcaatcgatggatatttccaccagtcagatgtatcacagtggtttcacgacaccgatgcagaaatttattgaccgtgaccattacgatgctgatcaaatcattccaggcgccaaggcgatcgtgatacgcgacaatcaattgctagcaatgccgtttaatgcatcgcaaacggcgctttattataataagagggtcttgcgtcagtacgggattacgccgccaccagtggatccgacttacgatgatatcacgcgagtcgctaaggccatccacgacaaatcccacggcaaagtcaagggaatgacaatggaggcctattcgtggctattcgagcagctggtcgctaacgcaggtgttcccgttgccaatcatgataatggtcatactggcaatgcgactaaggtcgactttacgagtcccgcggctatcaatgcgatgaagtgggttaaagaaaatattgactatggtgactttatgaactttggttcgggtggtaatgctgctgcaaatgaagcagcttctttcttggcaggccatttgggtatcttcatgcaatcgtccgcgaacacgggtcagttgtatcaagtgctcaaaatgatctaggtgtcacatatttcccacggccgaatggtcagagagccaacggaatcgcagttggtggggcggcactttggattgcgaacgataaaccaagcgcggtccaagatggcgcgtgggaattcactaagtttctcgctagcgcacagacgcaagccgattggcaagccaagactggttatttagccgttaataagggggctaaggacgagccaacgctgaaaaaactattcaagaagtcgccggtcctagaagtttctggtaatcagatgctacgaacgaagcctaataatacgaactcaggtgtctttgtcgatggttgggttcccgcacggacggcgattcaaacggcgatgcagcagatttttgcaggccaagatattcgacaatcgttgcaaacggctgaaaatacgtacaataaagtgttagaatcaaataaccgtgcaaacggtcgtcattaattggaaagagttgaagaattgtgccaaatatgtcgttgatttatggtcatcggggcgttcccgttaagtttcctgagaattcgctagctgggtttgcgtatgccatcagtcatcatatcgatggcttagagtttgacgtccatcttacccaggatcaaataccagtgattatgcatgacgaacgaatcgatcgaactactaatgggcaaggggccattgcggatctgaccttcgaacagttgcgtagatttgaattagcaaatggagagcccgtcccatccttacaagaatttttaaacttagtgagtggggagcccgttcacttgaaccttgagttgaagactgatcgacactattatcttgatatcgagcggattgtgctacggatggtccggcagactgacttaatttatccggtcgttttttcgtcgtttaatctgaagagtttacagcgggcctacgccattgatgccagccagaaatatgcttttttgacttcagcgcgtctgggtaatccggatgagtttgcgactcacgaacacttagaaggggtgcatcttgaacactatcaacctgtacaccatgttgctgaacgggtttggacagtggatgagccaatcgtaatgcaacaattgttcgcagcctcggtcaatgcggtgattaccaataactttgagttagcccaacaagtccgggcagccatgtaatcgagcgcaattgtgctagtgcggcattcaaagattgtcgtttggtaatgcgacactacccgcgctacctagttagctggtcgcgagtcattaagaagtttctgtattgtttgctcgctagattgtgcgcaataaaagcgctagtcccgataatggggactggcgcttttagcatgattaattaaactgtggttggattgcgaatcttacctaattcagaatcgatttgagctagcactgcttgttggttagcaggtttttccaagtcgtactgttgtaaatcaatcttcattttagggctagcatcgtattcatcgtaccatttccgataagcggtccacatcttatagtaataagattccagttcagggttgtggtcgaactgttcgtagtcgcgaccacgcttcttgatccggtaaagaatcgtatcgaagtcagtttcagagtagaccatcaagtctggtgccttcttaggcagttcagtcaattcggtcatcatattgtctagtagttgcaagtaaacattcaattcagtatcagagatgtttccttcagcgttgttttctttggtgaagagggcatcttcatagatggagcggtcgaggacgttgttatcgtcggccaatgccttcttgatcattgcaaaacgtttgttgaggaaatagatttgtaataggaacccgtaattcttaggatccgaataataaagtggcaatacggggttgtcgccaaccggttcgtaaaatgccttagttccaaggtggtcagcaattaaccccgttaacgtggttttgccgaccccaatcattcctgctgttattatcaccatgatagcccctctttataaaaaattgcacaatatattgtatctcaaaaaaagttttaataccatatagacttttaatgaaaaatttgcttgggagctattttcacttattttttagcctgttcctttaataaatcacgaatttcttctagatattgcgcggaaacatcgacttcttcttcctcgggttcttctggttcatttttaaccactttattaataattttcaccagaatgaaaacgacgatggcgacgatgaagaaattaatgatggcatttagaaaggacccgtacttaaaagtagcatcaccgatactgaactttagattggataaatcaactttgcctaagaaaatcccaatcagtggattaattaagttgtctgtcaacgatttaacaatggccgtaaaagcggacccgataataaccccaacggccaaatcaatcacgttaccgcgggcaataaattccttgaattctttgatcatgcgactcgcactcctttattaattgactgttaacagtatagccaaaatcaaacgctgactcaatcaatataccaatctaatttaaccgtaagcttgtccctaactaaagcatacccatactaatttgaggtggtatcatgattagttttgtttggatagtgacttaatgttgttctgaatgattgttgtggtgcatttgagactagttaatggttttagttagttgggctgttgactgacaagctagatgacttagcgtgtgtgacatccggtcaaaatgagtctgtgaaaagcagtctcaagtaatggggaagtcgtttcaatattagtagggattttcacgaatactaataatatggtagtaggttaaggtgttgaccagcgaatcagaattaacagcaccatttgggtaaagtcgtcaacttagttagctgctaaaaacgactctctctgatatagagaaagtcgttttggcagtgtttcgagatcataaatccaaataactaattcgttttattgtcagatgctttagcttgagcctttcgccgaaccaacgtggctaacttactctgagtggctttgacggcgacggggtcttcaaagtcaatttgagccagccgagggtaacgacggataaagaacaaccaggtcagagcaataaacagcattagaatcagtgctaagacgcccatctcaggaagagcagaattaccagtcattaaggtctgccgcaagctgttgacgctgtaactcattggtaaccacgggtggattgtttggaaaaagtgacctgacagctgaattggatacgttccggctgaaccaccgagctgtaagactagtagtaccatactgaagaaggcgccagctttgccgaagacaaggttaagccaagcgacgatcgtcatgaagagtagcgccgttagcgtgagtaacaaccaagtggcaaacggatgaatcgggctgagtccgttgattaacatcatcaagccgagcataatcgtactttccatgattgaaaagacgagcatgatgctggccttgctactccaccaatccagtgccgattgcgggtgtttgcgtggggtatacatatcaaacatcatattgagggcgagcgcgccgacaaataacgagacacttaacatatacggcgccataccagtaccgttgtttggtacatcatcacggtcctggtgagttgtagtgacgggtttggcaacttgttgatacgtcagttttgatggattgagattccccttgcttgcggccgttcctaatttggtcgctaatgcttggttaccagtttgaatcttattaccagcggttgtaacttggttagcacccacggctagttgctgagctccggtggctaattgcccattgccactagtgagttgctgactgccattagcgagtgcaatacccgttgtgccgagtcgatgtaagccagtggtgacttgttgactgcccgtaactaactgtgagatgccagttgttaagctgggtaggttggtctgtgcagattgaagacccgtagccacgcggctggcaccttgtgttagctggttgccctgggtgctgagttgacgcgtgcccgcggtcagctgttgagaacccgcggcaacttgccccgcacccgtagccagttggtgacttctctgattgagcaagttggtgttagcatccagtgttttaaagccttgggtgagctgctggctattagttgtgagcgttgttgttccgctagccaagtttgtcgcaccagtagtgacggccccaatgccattagtgagattaggtagggccgtgttcagctgggttagactagtcctcagtttgttagccgcgttaccagcagattgaataccggtcgtcagtgattgcgcaccggtagtgagttgggtgaccgtggagacaaggtcagcctgctgttgagtcgtggcgctgagggccctagtcaaagcagtcgtatctacagccggttgcgtcgactgggcgatggccgtggttaaactcgcaagggcggcgttgatggcgtcacggttagcggattgatcaaccgttgccaaaatggctgatttttgtgccgcagtcaaattttgactgtcagcggttgcggcgacattgtcgtgaagcgccgcactagttttaatagccgatgtcagcgcacttagcgcggttttaacggacgataagtcggtaccagcagcctgctttttcagcgctgccacggttgcgctaatcgtggcttgattgttggttggttgcttaagttgcgtctgcaatttttgcaagtcgatggtgagggactgactgttctgacctagtgtctggatgccagtagttagctgacttgagccgctcgttagggccgtcgttttagccgttaactgagcggtctgtgcttgtagttgattagcaccttgactaagcttgttggcaccagtgttgaccttgccgacaccggccgcataagcgtttaaaccggaactaagttgttgcgtaccagtcgccagttgagcggtaccactactgaattgttgcgtgccactggccacctgatgggcaccagtattgactttgacagtcccagtattcactcgctgggcgccagcaacgtattgatcaacaccttgatttaaagtttgaaccccggtgttgagttgagccatgccagcaactaactgattacttttgacgagcagttgtgttagaccggcaaccactttttggttacccacctgtagttgtgaaatgccattaagatattggtttaaaccgaccgtcagtgtttgactcccttgttttagtttcagcgaactagttgcgagggtgtccaggttggtggcgattttttggttggcagtttggagctgctgaccaccggtggctagcttttgattattagtagcagctgttttgaggccactgtcaagttgtttgatagcggcaaacatcgttttggcatagctcgttgtaatcgtttgggcgacggatgaccgaatcgaagtgaccgccgaatcggccatcttgctagcgacgaagttatgtccagcacttgtatcataatgtagcaccatggcttgtggttggtgattgagtaaggtggtcgcgtggcgcgaaaaattggttggaatcgtgagcaccatataatagcggccatttttcaagccagcttgtgcctgacttgcgttgacttgttgaaacttcaaagcgctagatttttttaaattcgttgttaaattgcgtccaacactgagatgcttcccttggtacgtgactggctgatcatgattgacgacggctacaggtaaattatttaaccgaccgtatggatcccacattgatcgtaaaaatgtcacggcataaattgatggaatgaacataatgattgccatgacgataatcattagtttgtgtttgcgcatatacgcccattctgctttaatcatctttacttgcgctcccttaattgtctattttgtatgaaaccccgtgtgtgcattaaagaggataacaggtttcagaaatagcaccacatcatcaagacagcatgtggggtttaaaccccattttgagtgcaagtggggtttaaaattaagggtaagttatgattttaaaaatattatgggtatacatagcatgaattgagctgtcatcaattatgataaaaatgtgttagttaggttactggtcatcagtaaatgtgcgtcctacatacaccttctaggctgagcggcaattgctataacatagccaacgtcgattcggctgcgggattgtccgaacgtggaaaagaagccccttaccatgatatttcaaagtaaggggcttggtatgagataagcagttaagatttccagacaattagttcatctggtttgaagtagagttgttggctaacaccaaaccgaactaagtattgatctttaactgcgtagtaggcaatgatcgttcccacaattcccaaatatggttttggtaacttgacggttgttccgatttttaaagttgacatgattgaaaacctcctaaattttagtcattatcaaggccgtgacgacggtaggcatagaagaagatgccacaggtaatcacgagccatccgagttgcgtcagtacctcacgaagcgtccatgaaaaaccattagtggcatatgaggcggtaatatagtgattaatcgtgctggtataaagatagctactaatggttttaagggtggtattgaactgttcgaaattcggtatcaggcttaaaatcagcatcattggaatactgtagacgcctgcttgagtttgactattagcaatcagaccaataatgtatccgagcacgagactcgttaaactagtgataatagtaatcaataaaaagtttcctaagtgaatttgcgaccaactggcgccgcttaggggggaccagtatcaaattggttacagtcataatagctagtggtggcaataaactaccgataaaaaattcgggcccggtaatggaagcggtcattaggacacgtaacgtatggtgttctttttcttcggctaagggataactcgtcatcatgatgccacccataacgatattaaagcatagtcccattcccagtaatagggaaatcagggcgacgtgtgatggtgctttactttgcataatactcttcatgaaaacgacgtacaaaatggccatgattggggcagtcattagactcatatttgaaatgatcagtcttaatttaagaccgaataaggcttttattttggttactgataaactcattttaggctccttccagttacggttaaaaagacatcttcaagggtcggctcgcacgagtgaatcgtctcaagttgcccagaaagcatccactgattaatctgataggtcgtctcaggagatgcggggagtaacaaaccttgcgctgccgatgcaatgtggacgcgatactgctggtcgcgattatattttaattgcaatgcttgtggggctgcacattctgcgatgcggccagcgttgagtaaggcgacacgattgcagagacgagtggcttccagcatatcatgagtcgttagcagaatcgctgtaccctggtcgcgtaattccctaatcagtgcgtgaattgcttgggtcgtgcggggatctaaaccactggttggctcatcgaggaacaagacttgcggttggtgaagaattgctcgggccagaactagccgttgacgcataccttgagataacttaccagcgagttttttcttatgttgactgagaccaactcgttcaagtaacttatcaacacgtgcaaccgggacaccaaacattttcgcgaagaatagtaggttttggtataccgataatttgtcgtaaagcccactttgatgcgtgacgatgccgattttttcatagcggtgttcgtcgtatgcttggacagactgacccaggacgtaggcttcaccgttcgttggtaataattgtccggttagaattttaatggtggttgtttttcccgatcccgagggacctaaaaagccaaaaatttcacctggttggacggtaaaactaacttggttcagcgcggtcgtattttgaaatgatttggcaatgttaatcacttcgattgcattttttattgtcatcgttgatcgctgactcctttaaatttgatttggaagcgtagtggcttctacaaaatctagtttactggaacaatcgtcgaatgtgattaaatcaaggtgtaatggggcatattggggccgaatggtgcattatttaggctgaatggtgtcctaaaaattgatcaaagcttttaaatcagtgagtttaccgcgagagaggggcagtttacttttgtttttcaagattaacgtgtaactatttcgggagtaactgattagttccgcgatttgttgtaaattaaccaagtaagaacgatgacagcggaagaagccgagcgtcgtcaattgttgttctaattcgctcattgtttgcgatgacgtgaattgttcgccactgacgttcagttgactgaccccgttgacactttcaataaaatcgatctcgttggggctgaaaaagactgttttatcttcaaccttacttgcaattttaaaaattggtctaggtgtatcttctgaagtgtgtgcggaatcggaactgctttcggtcgccaaatcagtcaactcgaggccctggtttggtcgatagcggaagatagtcgtactggttaggacaagttcttctaatgagtaggaggtcagcagtacggtgacgccgtgttcgcgagtataggctaaggctgctaagtacagctcaatgccagcgttggtcaagttggtcagtggactttcaattagtaacaagtccggttgtaggatgaacgcccgcagtaaggccagacgttgttgttgatcaaaggataagtgcttgatcttagtatgggcgacgtctttgagtgcgaaatactgcaaaatgtcatccagatccgtctcaaaggtgctgatgcgttgaaaagtcttcaaataagtcgagactgttaattgcggataaaagccgtcatcatgaaagatggcttggatacgtgcggtagtgaggccagtcatgacgccactagtttggggcgtcgtttggcgtaataggttgaatagggttgttgcctcaacgtggctcatctgaatgccgatgttactttgcgctggaatggtgagtgtgaaaacttttaaaatcgtttggtgtgcttgttgtttaaagatgttgcttaactgaattgtttgcatggtgagaacctcgttgtttttagtgtctgagtgaggtggttagaaaaaggccatatcactcaaacaaattggcaaatctgatgtagacagtaacaatataccatatcgaagtaggcagttgtggtttgtcctgattaagaccgttatgtcaaaatgacagctgacatgatgcaaaataccgcaataaaaacaggacaatggacggccggcattcgtatggcgggtcaatatcctgttttttaaaattaatgtttgatgattgaatgactaacgagattgatcaagtggtcataaaacacttggtcaattgataataatagcaatatcagaaatggccaaccaaacggtctctgtgggtgattataagcaattactggcatcactgttaagcccatgtggatgaaacttcctaataaaatcagccacaagctgattagggcccattgcgatttttgccgcatgtttatgcgcctccataacaattaagtatggcacagcgattagtgcttgaccaattgattccagaagcaggcaaagtcataagttgtgactgaaccgccaagctagaatttgtttttgaatttcaaccaatttagatagtgatcatgggcttttttcagttgtcggtagcgccggggttgtttgcggtaaaaatcctgatgataattttctgctggccaaaattgctgtaagggctcaatggccacgacaattggtttttgataacgttgcgagtccacaagcgcttgtttggatgcttgtgcaatggtcaattgatgttgattagcataaaaaatgactggccggtattggctaccgcgatcattgatttgtccaaagcggtcggtcggatcaattagttgccaataaatatcgacaagattttgatacgagattttacgggaatcgtatctgatttccacggcttcaacgtgccccgtatattgaccactaacttgttcataggtcggttgggcccacgaaccaccggtataaccagaaatcacattattaataccgggacgctgatcaaagggctcaaccatgcaccaaaagcacccaccagcaaagactgcccgttcttcataaggcgaactaaggggtgggtaagccgatacattgtttttagtcggcatgggtgcgttgccagtgatggcaagataaaagtccataacatccggggtcaagttattccgcatagctaatggtcgcaaatcagcttcgagctgttttagttgcccagtcggcgatagctgttgccgattattcttggcctggactagtaaatggcgttcccagtcacgcgtcgccgggttgatgattaaattgtataagtcgcgcattaaggcttcaggttttgttttcatggtgtctccttaactggcttatttgccgagtattagcacgtacttgtattttgactgatttgattttagcacggtgctttggtagcacataatgttatgatttgttttctatcaccctgtcgtaagctactctaacaagaaatgcaaccagatgatattgatgtgatcgttagttgcatcttagttataagcaccgtttggccgacgtcaaaaatggcggctattattgtgggtattattcacccaagtccaatttgattggaaaagcttgctatgaagtatggttgatagtttataatgaatcgcatgcgaaaaaaggaggaactaaaattggatgatgaagtcgccaaatatacaacccaagagatttcagtattagttgggatgagtgtctctcaggtccattactatgatcgcctgggcctaattcctaatctaagacgatctgagaatgggtatcgtgtttttacggaaaagaatctgatttggatgaaaaatttgaagatttttattgattccgaaatgccgttgaaggatattcgtcaactaactgatttagttgttcaaggcaagcaagcaacagcggaaaagcgtcaagcgattgttgaacatcatctgaaagaattagagaaaaaacaggctgaacttaagaaacaggtcgcattcatgaacgggtttattaaaacatatcagcaaatggaaaaggagtccgatgaacgatgaatacagttttagttattggtgcaacttcgccaactgcccaggccttcattaaattaatggaacgtgattatccagaaatgactttaaaattatttgttcgtaatcgcaaaaaggtcccggcctatcagaaacgagaacatgttatttttctgggagatgcagcgaaatatactgattatgtagcggcactcgaggatgtcgattatatttatgattccgttggtgggctgagcactggtccgtacgttaagttattgttacgtgcaattaaggaaacacaggcaacaattaaacgaatagtcgatatttcggcaggcggtatttacggtgaatatttgtctggtaatttaccctatttatcggctgttcgcacgcaacatcctcagtatacccatgatcagttagacaaaccgttgttatttgcaaatagtggtattccctttacaatctttagaccaggactaattcagaatggacccgaaacaaaaattattacgcacggtcctgaatttagagcgataccggagtctgaatttgcaattaatcgagatacgtttgctagggcagcagccaatgccttatttaatgatgactaccacaatcaaagtgttgctatttctaatggtgaactattatagaggagaaacttttgtatgaagcgtttagttggaactctgtgcggtattattagtgccgctttatttgggctaggtggaatactagcacagcctttgttaagtgagcaagttctgactccgcaacagattgtattgttacggctgttaatcggtggggcaatgttgttgctatatcgtaacttgtttttcaagcaggctagaaaaagcacgaaaaagatttggacacattggcgaattttaacacgaattatgatatacggcatcgccggcttgtgcacggcacaaattgcctttttttctgcgattaattacagtaatgcagcagttgcaactgtctttcagtccactagtccgtttattctgcttgtatttaccgcgctgaaagcgaaaagacttcccagtttattagcaggaatgagcttaataagcgcattgatgggaatctggcttattgttgaatccggatttaagaccggattaataaaaccggaagcaattatttttggcctgattgcggctatcggggttatcttatacaccaaactacctgttccattgttaaaccaaattgccgcagtggatattttgggatgggcactagttattggcggtgtgatagcgttgattcacacaccgttaccaaatttagttagattttcaaaaacgcagcttttagcggttcttatcattgttattctagccaccgttgttgcgtatgatctttatttagaaagtttaaagctaatagacggatttctggcaactatgactggactatttgaaccaatcagttccgtactttttggcatgttattcttgcaacaaatcttggttcctcaggccttggttggtattatattggttgtgggtgcaattatgatactgaatttacctcaccatatcacggcacctgttcccagcaaaccctgtcaatgtacgatgcctaatcagtagggaatgataagcaatcaataatatcaaaagtactggctttaacaacatattgaagaaatactgccaattaaaacatcggtactgcgattaccttttcgtaatcatataaagctattgttttttgaaagttgggtcattgagcacagtaattgactgtttcagttttagaaattgattcttagcaggtcgcatttttgaaatgtcttaacaaacgactaagttaaatttcacaaatggctgtagcacctataattgcacgctgtgctaaaaactgcgcgtatgtatggataaacattgagatttcaacgcaaaaataaagcggttgcatttccgcacgtctttcgctagagtggaatagtaaacctaaaatgaccaagtttcagatggtcaagcggatgagagggaactttaatatgtataaaatgattgtttgtgacttggatgagaccctgatgaatgacgatggtacgttgtcagaaaagaatgcggtggcaattcaagctgcggcggctaagggtgtttattttgtgccgaattctggtcgtagttatacctcgtttcagaacgatttggagacgatggggttgcgggaccaaccacatcaatattcgatttcttataatggtggtttgattttagagaataaggataatcggccattggcggtgaatgccatgccatatgaggttgctaaaggggtgtttgaagcgggaattgcgaatcagcaggcggcgacgcatgtgtacacgcaggatacgttatatatttacaatccggttccaagtgattcagattatctacaaaaccggggcgtgacgttcacaactatgacgacgccggactttgaacaattcaaaacgatgaacgtcatgaagattattatggccttgccaacgatgactgaccgcaagcaaatgcgcgcagacgttgaagctattgttgatccaagcaaattagccgtcacttattcgtccgaccgttacgttgagtttaatccggctggcgttgacaaggggaccgcagcggttcaattaggaaagctactgggaattacggcggatgaaattattgcagctggcgataacagcaatgatctccccatgctgaaggcggtcggattgcctgtgagtgtcgccaatggtatcgatgcagtcaaggccgcagctaagtacgtgacggtcgctgataacaaccatgacgcgttagcagaggttattaacaagtttattttatagtacaaattttatttagaaaatgaaagttgccatttggcgttcaacttttacaagtggtatcatgataattgaaaatgtggcagtatgaaataaattatttgttacaaattactgaatgggggaacacgcatgagtgcgattcgcgacgatttagctaaagcgattaagaataccaacctcgttgaaatctattccaagggaaccaatgagcaatttagtgttggctatgtgattcagcaggatgagaagtttgtgctggtccaagccgttaatgtcgatggtgaactagatgggttagtggtctttcgtaaggcatcgttagcccgcgtaattagtgacactgattatttgaagagcatggcgacgatcattgcgctggctaagcaacggggctattatgatgtttggaacactgaacgattgatgaataagctgctgaagaagcagaataagactaaacattcgctcttaaaaacattgttgaagcaagcttttcaccacgatcaagtgattcaactatctggtcgaatcaaaaaacatggtgacagctatgctggctttattcatagtgaacataagaaatatattgaatttaattatgttgatatgttcgatcttgcaaagcgcccacaaattgccattcgctacgctgaaattgatgaggccagtttccatagttttgaaacctttaatacaaccgcggttatcgagagttttatgccgggtgattttcactaataatgatctgtgagcggcaccgttaatgaacgggggtcgctttttttataccgtcgatcacgtgtgtcttttaagataataaaggcgagtatagcaagttttgaagacggttacgggtattaattggtcagtcagcgatttggtaaagattgttaagtttttatcgcacaaatatacaaactggccgtatttcgctacaatggtagtattgagcatcatgcggggaggggagcagttatcgtttacgtctattggtatattgcagcttttgaccattggtactcggtcatgctggtttttttactgcagatattaatcaatcgtgagcttcgacagaagcgagtctatgcgactgttgcggttatgaccgtacttctaactgtgatctacatgttgtattacgactattcggatatcatcacgttcattgtggacatggggttactggcgtttgtacggcgcaaaaagtactttattgtgacgagtctaacggccacactcgcctacattctttttagtttctttggcaattatgcgacggagtcgatttttcacttattcaacttgggtttgaatgactggagtggctggctatttgaagccatcggtgaaacaattgtcacagcttgtatgttggcagtcgccgctagtttcaaggtcttaaagaagcgttatccgcggcaatttgtagacgggctaacgttgaacgtgattgtcagtgctttggctgtagttgcggtcgcgttttttaccatcacgactgcggcggataattataatattggctcaggatttttggggattctaatgttgattctagtggctatcttgctgatcaacgccggaacgtttctttacctgttctatagttatacattgcgggttcaaaataaccggcaagctttggaacggcaacaatatgatatttatgtcaaaaatttggaaaatagttatcaaaatttacgtaagtttcgccatgattatcaaaacatcttactgtccttgggtgagtatattcagacagctgatgatcctgaattacaacaatattttcgtcaagttgtgaccaagtctaagcaaagtctaaatcgtgattttggacactttgacaatttagaacaaatcaaggacaaaccattgaaagccattattcagagtaagttttccgttgcgcgccaagctggaattcaagtacgcttggaagccaacgacccgattgcggcaattgcaattgattcagtgacgttatcacgggtgagtggcatcttgttagacaatgccatcgaagcggtgaagggtcagagtggtggtcagattgcggtcgcacttgttaagtatccccgcatggtggagttgatttttgccaattcattgaatcatccgattgagcgcctggatgagctgatggttgctgggcatacttcgaaaggtgctggtcatgggcaagggttagcaaccgttcgtgagttgttagatccattagctaacgtgacttatgaagtgagctcccatcaacgattcgaatttattattagtattgaaagtgagtgagcagcgtgttaaagacctttgttgtggaagacgatcctgaacaattagcaaccttaaagcaaatcattaagaatcatattatgattaatgattttgatatggaactgaccttagcaaccggacaagcacaaacgttgttggactatgtcgagaccaattccgatcttgagggactctactttttagatattgaatatcctgggcaagacttaaatggcctagcactagcgactcgaattcgcgaggcggatgttaatgcgcggattgtcttcgtgtcgacccattctgaaatggcttttttgacctttgaacgacgaatcgaaccactggactttattgtgaaagatttgggtcaagaaacggtcaaagccaaagtggagacagatattcgggttgcttatgaacgttataccaagcaagcagtcaccagcagggccatgttttcttactctaagggtggtcagctcttcaatgttccattagatcaggtgttatttatcgagactggagcagttcgcaataagctggttctccatttaacagatcgaattgttcaatacaatggtaagattagtgatgaaaccgtggcccacccagagttattccgggttcataagagtttcttggtgaacccgcaaatgctagtacgaattgataagcaacatcagcttggctactttgaaaatggcgagtcggtcgatattgcgattcgtaaaatgcatgatttaatcgcattgatcaagcgctccgaactggcagtcacgtttagctagcttcgcttaagactctaatgtaacaaaatcgttaatcaaaagtgaattttaatgacgttggtgcaggctattatgagctttgcaccttttttggctttttagattaatttgcatgtatgcttagactattaaatgccagctgtgggagctggtctggaggtggcgtcatgaagcagttctggtcactaatcttaatgattttggccggttgtttgttaatatttggttcggaatacagcttgcaaggtgattatcatcgacgaattcatcggctcactgtgtcaaaggtggtttaccatcaaaatgccacctctgcaacaatcagtggctgtaccaagcacggtgtcattgtcaccttaaagagtgggaaacatgtccgtcaggttatttcgaataagcagagtggtcaattctatgttaaaatgccagttcataagcggattacaattaaagtcgtggggctaaaagccaaagtactaacagtaccaaccgggacaaagagttagatgggtgagcgggcaagttgccggctcttttttgatggttaatgactaggacagcgtgccatataaaagctacggtgaactactcgaatttatttagttgttagtcgcgttacggggttgctaaaaaatcattaagcttctagttttgcgctaggcgcattgttgattttagcgtacagtaacaatgacaagaaaaggagtcgtggctgtatgttagtggttggcattattttggtgattggaatcatcgggacactggttttacgatttcaatttcactttcgcctcgcgatgggcaccattaccgagacggcgtttgcctgctcattgttgaatatcggggtatttttgttgtttattttattgggtcagttaacgggaccaatcctgctatcaggatgggcctacttgccgatttatcggttgttacaaggaggtttgattcccgttattggcattggcttggcaattctgggaatggtgcgtgagaaaggcctgatgaattggtggctattacattttaatgtgctatttttgatttttgacgtgttattagtctggcaggggagttataaaagttagagtggccagtgccgtgacgaagttgtgcgtgaaggtcgtcaatgcagtaacatgatggtaattgctaggctattgatcacaaagtggagcgcaatggccgcgcgaattttacgggtcagccgataaacaatagctagtacgagtcccatggtgacgtatatgaggaagctcggtaaggttgaactactatggaggctaccgaaaacaatcccgctgagcccgaccttgagccattcttgttgaaagaaaaggttagtcagaacgccacgaaaaactaactcttcaacaattggagtcaaaaaaacggcgctcaacgccataagccaaagcgacagaggactgccggccattaaatttttaatggcggcgttattttgtgtttgattctggtgatacagaagctggtttataaattgaaagccgccctcaaaaattaagatggtgagataggccattccaataatttgccagtcatggtgttgtaagttttctgattgatagttgccggtatagtgccgcattagggcggttgccgccagtgctaggatcacaaaaattaacagatagacacctgccagggtgatctgccaggctgtgagctgatgctggcgatataattggttaattaatttaagtaacattggtgggatcacgaccccaacaattaggccagcagtgagcaacacgcgtccgagccaccccaagccgcggtcaataatttccatcggacttcacctcccatggttgattttaccgcagtgtttaggtttcgacacggatttgcaaatctgagaaaggcatcgatgccaggcacaagcggatgatattaatctggttgaatgctaaaaatataataattgtagaaataatggttgatgctctataaaaataaagaataaaaaagcataattcggacaaatcttcacactttcttcacaattatgtaatagtatatacttgtacctaatagttatacacttgttcattttactcccccaaagtggatggacgagcaagtacaatcccccatattgtacttaaacctaactctttggccctactgctactaagcggtagagtcatttttttgttgcacgtccccaaagtcaccgaatacagtacctgcaaaaaatcgtcccttaatacatacttaaattatttttagcggtctaaactatcaaattcaactgggttttatcatttgatttattttttgcggaattaatgtggctgcaaacccccataattatttgattggtgctagctaacgattgttcatattagccttgaacgggctagtctcaaaacaaagtgacgctagtgtcaaaaatcaattggtttaatcgcaacaaaaaaggccgggttagaaaaacctcgacctagttaagcagtcagttagaatgcttcaccagaataggcgacctttttaggatcggcatttttgatgtgttcggaagcaaagttaaccgtttcgcgaatctggttataggttgcttcatctaaaccaagtaaatccatgcaagaattaacgtgggcaaaaatctctggtttagcatcgatggctttttgcgacaacgagatgttgacttggcgttcatcgtccgtatcgcgcttgcgttcgacccagccttgggtttgcatccgtttcaataacggggtcagagtcccgctatcaaggttaacgtgtgaaccaagttcccggaccgtcatcggactcttttcccagagtgccaataaagtgatgtactgcggataagtcagcttgaaaggtgctaaagcttcggaataaaaatgattatatcgtttgctggcggtgtagagcgcaaaacagagctgttcgtcgagcaaaatgttttttgttggggttgccatcaaaccgcctcctttactatctattttagtacattgtacgcaattaattcgccaaatgcaattaatattgcgcaaatacattgttttcgaacgatttatttataaaagcgggttaattaattgacctgttggcgttgttgggacttaatgcatgtcaggaataactgggccatggcctgctgattgatggcaagttgatggttgtccgtgaacgcataaagtggaacttgtgctggcaatgttttggccgcgtgatcaccaactggaatcaggcaggcgatttttgttttgtcatgtacaaattcatgagcgtcacgtggggcggccttaatcgtcagtgatgccaatacgtgataaccggtcggcatcatgtgttgtgcatgtttgacatgcaccccgtgtagtcgggaacgtaactggaacccagacgtggtggtcaactgtaacgcttgctttaattccaataaataagtttgttgattatcaatatttttcaaccggatcttgaagtgtccgaatggaatggcgcgatcctgatgttggacggctaaggcgtgttgttcgacccgcattttatccttaacgggctcaaaggtatattgttgtaaaaattgtgttgctgttttcaaactatcactccctacgattaatttagtcctttaaaaacttgtggtcaaataattggttacgtttgcgagtgacgtcgttttcaagtaaaattaaagtgatagggggttggaaaaatgtttatgacaactggtgatttacagcgctcccatatgattaagggcgtcgtctccgtcacaaaacacctgatgtttgaatctgatggtgttgatcagtttgaacggtttgacgatttaatcgaacaagtcaagccactactgctacaaaaggcagaggatcaaggtggcgacgggttaatttatgtgaacttcaatactgaagtcgctcagatgagtgttgcaccacggtttttgatcgtaaccggctatgggacggtcgtcaagctcgttgatgaatcagtctgatacttaggatctgaattttcaggtccttttttgatagcaaacaagtgatagaaaggaaggtttgatgaccagttattcatttccacatggcgccattgacgtatacgacgctacccaaaacaatttaaagcacgttagtcttcgcgttcctaaatatgcaaccacggtgttcgtgggcttgtcaggttccggtaagtcgtcactcgtttttgatacgattgcagcggcgtcacggcgcgaactgaatgaaacgtttcccagttttacgcaacaatatttaccgaagtatggtcaaccacacgtcgggcatatcgagcacttgcccgttgcgattgtgattgctcaacaacgcctcggcaagaatgcgcgttcaaccttggcaacctatactgggatttattcgttactgcggctcttgttttcacgggttggggaaccgtttatcgggtattcggacagtttttcgtttaacttaccccaaggcatgtgcccaacctgccaaggtttaggttatgttgacgatattgatgagcagcaattgattgatcctgagaaatcattaaatgagggggccatcacgtttgtgagttttgcaccggatacgtggcgttggcgccgttatgcgacgagtggtttgtttgacaatgataaacccatcaaggattatagtgctgcggaatacgatttactgatgcacgcaccgcaacagaaattagcccatcctggagaaggttttcctagaacggccctgtatgaaggcgttgttccgcggatcaagcgctcgattattggtaagaaggaagccgaacaccatcgcgatgcgattacggcgatcgtcacgcgcaaaccgtgcccaacgtgtgatggcacacgactcaaaccggtcgtgttgaccaatcatattaacggggtcaacattgctcaggtgacggcgatggatttaaagcatgttctggcatttttacaagcgattgatgcgccgttagcccaagatattgtgcgggagctgacgaccaagatccaatcgttggtcgatattggcctgggctatctgacattggatcgtgggaccagttctttatctggtggtgaagcgcaacggattaagattgccaaatacttgaccagcgccttagtagatatggtctacattttggacgagccaagcgttgggctgcacccacatgatattcagttaatcaagcaagcgttaacgaagctgaaggataagggtaacacaattctgattgttgaacacaatccagccatgtttacgttagccgactatgttgtcgagatggggcctgcagctggtcgcactggtggaaacgtaacctttactgggacttatgacgagttactggcctctgatacgttgacgggccggtggttgcgacaaccgcataaatggggtcaagaacgaccagtccaggcccacttggcattacaccatattaatgaaaataacctgcacgatgtcagtgtcgacgtgcccctcggtgtgatgacggtcgtctcgggggtggccggttcagggaagagttcgctggttaccgcgctaaaacggcaattaaagacggattatattgatttagcccagacaccagtgggcctgaatattcgctcaacaccggcgacttacttaggagtgctcgaccaaatccgacaactattcgcgaaagccaatggcgtggcaactagttggttcagctataatggtaagggtgcttgtccgcggtgtaagggtaaaggcgtgaccatcacgaatatggcctttatggatcccgttgtgcagacatgtgaattgtgtcatgggctgcggtataatgaaacggcgctcagctatgcttaccagggtaagacgattgccgacgtgctccagatgtcagtcacagcggcgttagctttttttgccacgatggacaaagtggctcagccattgaagaatttagaccgggtcggtttgggttacctaacattggcgcaaccgctcaccactttgtcgggtggtgaactgcaacggttgaagctggcggttgagctaggcaagcagggaacggtgtacttgttagatgaaccgactgccggtctgcatttgcaagacacacaacgcttattaaaattattcgatgccttagtggccgctggtaactcgttgattattatcgaacataatctggcggtaattagccaggccgattggttgatcgatgtggggccggatgctggtcagtatggcggccgaattcagtatagcggaaccccacgagcagcagttgacgtgcccacttcacgcactggagccgctttgaaggcttggctgaaggcgtgattagaaaatttgattaaataaaaagcacgtgcaattgcacgtgcttttttagaagggcggtaggtgggaatcgaacccacgcgtgccggagccacaatccggtgcgttaaccacttcgccactaccgccatcacgttaacttttcgtcaacatatctagtatacactaaaatcgtgggttgcataggactttttgtggattttcagaaattaatcgcctcagtttctgaagcgttggtgaaggttctactgtgaccaacaattatttaacctttagtaaaaggccatagttcccctaacaatgggagctacggcccgtttgccgtggttagtgtgtctaacggataggtgaggtggaccagcacttatcggttgagcaaaattattatgaattcatccttattgaagaaatgcgtaaaaatctttgcaaaggcactactttgttaaaattcacaaaataaaagagcccagtaaataagtgtttaccgtggctcttttattgctcatagactaattatgccccaggcaggattcgaacctgtacattgtttccaatacagcgacctgaacgctgcgcgtctgccagttccgccactggggcagttgctttaacaacaatatccattatagcgaaaagtaacaaaaaaataaacctttttctatatttatgcagttgatattaattgtaattgcaaattggttgcttagttactggggctggccttaattagcatggaataactgtacgccgaaatactgaaattactaccggcaaaaaatgcatccaaaaagtcacccatcccagcaggttcaacgacactgcttgaatgggtgacaacttgtctgtttattaatttgcttgtttggtcgtgatactaccatctaaataaacaaagtaactattcagataatgcccccggccgccattagccgttttctgataagcatcgacctgataatagtggtggccgtgtgcatcttgattggcagttggtacgacaccaaaggtttgttgcttgggatcgttgagcacttgcccgacggcggccactgcactagttgcgctagtgatatggtcgtcagcagcttgataatggtcaccagattgcttcttagcactagcatcagccgctgcattggcacgactagtttgctccgcgcggttagcggctgcaactgagttcgcttgcttagtggaaatacttggctcagcttgggaagtgcagcctgctaaaaggaatagggcgcagaaactgattaaaattgcccgggtcacgttcggacctccttatttcgtttgttcttgggacaagctcggataaggggcttgtcggatgatgttcgaatcaacgatggtcatcacaccgattgacagaagtaacaggatcactaagattaattttttcattaaaataacctcacttgataacggtgattgacctatttccagttagggacccaaatgacgcggtcaatttgttcaggaatgaccgtaatcttggacccagtctgtggcccagcttggacgtcgatcacatatgagatcggaccagcatcgacttcaacaatcgagccacgttgaccgtcgactgtgtcgactaaactatacaatggaatctcatcattgctgatttccatttcatataaggtgaattggaggaagtaggactttttaccggtcttgatttttaagggggtgtcaatggcaccgtaatcgggaagggcccgattttgagcgttgggatcattcaggtactgcatttcatcgacagcatcgatcgccatcttccattcaccaccagttaaattagttttggaggagagggtcatgaccgagttagcgtaaatgtcgatcacgttgaaggcttcgtcgacctgctttttcggcagatagccgatggtatagccatgctccgcaacttttagttcaacccgtacggatcgctcagcaccatcaacttcttcaactaactgaatttcaccgatgttagcgttagcgtcgacacggtacttcttggcatagagataatctgctttcagaccagaatcattatagccaccataaggtttaaagtaacctcgggcactcgcatcggccagcgcggcttcaaattctttttggtagtaatctaaaccaatgacgtatgagcggaaaattgcacgcgaattagcgttgatccggcgcgtctgaggaaccgccaccggatggggaacggcttgattcaagcgattccgaaaaccgttattttgagtctgcaacttggtaatttgacggtcttgttcctgattggtcaaagtttgatgaacgaggcgctgccgaattgatttaagcaacgcggcctgtttatccgccgcctgattgacatggtggagatggactaacaccgcaattaagataatgattaaaattagacaggctaagatcagcccggcaataaataaataagttctcataaataattcactccaaaaagaattgcagattagtttaagtataagcgaccagcccactaagcgccaatttaacggctgagcttgtcagggggccgataacaaggtatgatattgctattgtataatatttttgagctagaagaaacggtggcgaacggcgtgcagtggttgattaaaatctaccatcaatatcaatatttttggaaatacgcactgtttggctttatggccgcgctggtgaacgtcttggtattctgggtgctacactcagtcttggcggaacactatttattttccaacacaatcgcatgggtgctagcaactttgtttagtttttttaccaacaaagcggtggtctttcagtccaaatcgcaagacttttggcactggtgtcgcgagttcattagtttcatgttgacacgaggcttatcatattttttcgatactttcctcatgttcgtcggcatttcgttgttgttctgggcacccctacttgttaaaatcatcgaccaggttctcgtgggactctttaactatggaacgtcgcggctgatttttatggaaagcaaccagaaaatgcgaatgcgccagcaaatcatgaaacgattgagtgatcgtaacaattaattggcatcaggcaagcaagtcgtcccctaacggacgacttgtttttttgatagcatcactttggatcgttaggcagtaatttcaacgacattgatggtttaaatcaagtttcccgtcaattgccagtgcaagccgatgccacaaataatcgttagtaaggtgccgcagacgagtagggtgacaagtccagagttcaaatgactttcctgcttgcgggcaaaggccacttcaatgaggccaatcgtgccaagaccgagtatcacttttagcaaggtcaaccaccagttgcctgataaggttctgattgccaaggccaccccagtgatgataattagcaggtacccgatgcgactaagaatcaaaaagcgattggctgatttgactgagtgacgactgagaccaatcgcaatcgtcagcatgagccatagccaaccaataatgtgccctaataagtacatgacaaaaccgcctccacatttacaattcatgtctaattttagcatgaaagtaggtgttggcggcggtttcttttattgtactttaattaagtttttctgttggatgtaatcgactaattcaatgaccgttttaaagcggttaaacggtgtgacgatgtgaacgccgttgaagcgcgcacagataccatcaatcaattcctttgcaatggcaatgcccactgcccgttcgtttccggttttttcggcttctgccatgcgtgtcaagataggttctggaatccgaatgccatggacttcatggtgtaggaattcagcattacgccgtgagacgagtggcataacaccaatgaacactggcacgttcacgtgattagccgctagagcatccgccaaagcgtcaacatttgcaagatcatacacgggttgggtgataatgtagtcacaaccataacttaacttccgactgattgacttggtcgatatggaagtgcgataagcgttaggattaaaggcgcctgcgacccgaaagtcactggcttctttaagcgacttacccgttggtccgatgccgctattgaattgcttgattaacttcatcagttcaacggagcgcacatcactgaccgaagtggctcccggaaaatcaccgagtttggccagatcgccagtgatagctaagatgtcctcaatacccaggctgtgtagacccatgatctctgattgtaagccgattagattgtggtcgcgggtcgtcaagtgcacgatcggcgtgatgccgtagttcaacttgagctgcgccgcaatcgtcgtattagcaatccgaaccgttgctaacgaattgtcagacagtgtaatgccatcgacaccagcggcttttaaccgttcagcaccccggaaaaatttagtcgtatcaaaatcgcggggtggatctagttcgactaacgccgttttttgggtcgcaactttttgcagaaaccggtgctgactctttgtcgtgacgagcgttggtggctgtggttttgtagccggctggtcatgagcaacgatgctgcgattacttagaccgcggacggttgcgctggtatgcaaaggtgtggtcccacaacaaccaccaataatgttcagaccgagctgacgaaagcgttcggcatattcttcgaaatagcttggttcaccatcgtagaccaccgcaccgtcctgatcagtgccaggcaagccagcgtttgggtaaacggctagtttgacgttagctggaatcgccaagttttcaaatgactgagctaaatagtaaggtcccaggcgacagttcgtgccgattacgtcggcgccggcagcgttgagttggacgatggcatcagtgaagctcgtaccgtttcgtaagacgccgggggctaacattgaaacattcgtgatgacgggcaagtcagtatgggccttcacgatttttaacgcggcgagtagttctggcaaatcataatatgtttcgagcaagatgccatctaactggttggtggctagaagggcggtaagttgttcagtcacgctggcagcaatcgttgctggtgtcgcccgttgaacagttgcatcggtatcgccggctagtccaccgatcgttcccagaatgtaaacggggtgatccgcgtgttcccgtgcggtcgctgcaattttcacagcggcctgattgatggtggtgacttggtcttgtaaatcataccgggtcaactttaggcggttcgcagcgtaggtgttggtttgaataatatcggcaccagcccgaatgtacgatcggtgaacgcgtaagatcgtgtcgggatgcgtcaaattcaggttttcaaaagccgaattgatgccataattaccatataaaagggtgcccattgcgccatcggcaacgaggacccgttgctggagtgcttgtttaaacttcattcaagccacctccttagtggatgctagtggtcagttgggcctggatcgcgttgcgcgcagcaatcatgttctttaaggctgctagggtttctgattcttgccgggttttgagaccacagtcaggattgatccagaattgccgggcgtcgataacgcgtaatgcgcgttggatgttggcttcaatttccgcaacactcggtacgcgtggactgtgaatgtcatagacccccagaccgatttcttgatcgtacccggtttgttcaaaagcactgataatctccccatggctacgggacgtttcaatcgaaatgacatctgcgtcaagggctttgatggtatctatgatatcggcaaagttagagtagcacatatgggtatgaatctgagtgtcgttttgcacgccggtcgtggtgatcttaaatgagtacactgcttcatccaaataggcttgccaatggcgttgcttgagtggcaaaccttccctaagtgctggttcatcaacttgaataatcttaataccagctttttccaagttttgaacttcttgccggagggccaaagcaatctgattttgaacctgcgccctagggatatcgtcgcgaacaaaactccagttgataatggtcagtggtgctgtcaacatgcctttaaccggctggtcggttagactttgcgcgtaaacggactcagcaacggtgattggttccgtgtaagcgacatccccaaagataacgggtggccggacgcctcgtgaaccgtatgattggacccaaccattttgggtcgcatagaagccagtcagtttttgaccaaagtattcgaccatgtcagtgcgttcaaattcaccgtgaaccaggacgtcgaggccgaggtcttcttgtagcttgatccaccgtttggtttcagcatgcaggaatgcctggtaatcggcatcggttaaattacccttgcgccatgctgctcgttttgctcggacttgcgcactttgcggaaagctcccaatcgttgttgttggcaggaggggtaggtgtaaccggtcgtgctgtaacttaatccgggtcgcaaatggcgcctggcgttcgaatttttgattactcagttgcgcttcagcggcgcggaccgactggttgttgcggtgactggactggttgagggcagtcaagttggcctgattatggtcgaacactgcttgaacagcggcaaccccctgattggctgccacggttaaggtatgcagttctgccaatttctggtccgcaaaggccaggccgcccagtaagacggggtcagtcttggtttcatttttggtggtaatgggaacgtgtaataatgagttggccggttggagccataactgatcatcggtcacgatttgccgtaactgctgaactaatgcaagttttgcttgtagatcactagcccagacgttatgtccatcaataatgccagctgcgagaattttgtcggttgggaagccgtggtcgaccaagtgcgccagattttcaccatggtcgtgtactaggtccagtccaagtgcttggattggccaggtcacgatttggtcgtactgatcaagactgtcaaaataagtttggagctcgatttttaaggatgggacagccgcatgcaaatgttcaagtgcagtttgataaggtgcgagttccgcaaccgtcgttgttttgactagggtcggttcatccaattgaatccattttgcgccagctgtcgctaattcttcaaacacttgttggtaaagcggtaataactgcggtaatagttcgttgacggcggcgtcatccaagtactgtccgtgacgtttacccagtttaaggaaagagatgggacccagaatgactggtttaccatcaatgccaagttcttgcttagcttcttggtagtagcgtagccagcgattatctaataacttaaaggacacgtcatcgaattcaggaacaatgtagtgatagttgatattgaaccactttgtcatttcggccgccacggcggtatcagttccacgggcaattgcatagtagtcgggcaagtccaactggtgatcgaagtgaccaaagcgacttggaatcgcgttgaatgcgactagtgtatctaaaacgtgatcgtaatccgaattgtctgcgaccggaatatagtccactcccaagtcgcgttgctttttcaagttagctaggcgtaattttttagcagtggcgtgaaaggtcatgttgtctaattgtcctttccaaaagtgttccaataagtgcttccattcacgatgttcacctaaacgtggataccccaagttactattaataattgtcattaaaacccactccttatatttagcaaattattttaaacgaaaaaacggcaacctcatcctgattaaaggacgaagttgccgttcgcggtaccaccttaatttgtcaacacctcacgatattggcctcaatccgtacgtttcatacggaagcttattaacagtagctaactgtcatcacctggcaaaagctcagtggtgccgtttggaggccatttttcatcaatcgtcttccggtttggtttgcactattccaaactcactgcacgggtagcgatgattactttcctcttcaggacgtttacatgttttatgattgattagaaaataccaccaatttctaatttagtcaaatcattttttaattttttgcacatattcaaggcgtaatgtgacgcacacgctatttggagccaggcaagtaggaaacgtggtgtgaacagccactagtatttgccagcaaccgttgtcggattccgaccgcttgaactggtgaatagggttgaaacgcagctcccacatggttgggttgacattttaggccttcataacaggggcgttgcgccaagcattcaattgaggattaagttggttaagggtgctgacgatattgagtgaaatcaggtgctttggtaatcaatgcactggtataaagggattttaatagtcctaaaatttgaatatttcatcaaaactgtggggaaatgtcctaatctacacccagcagattaccgggtgcgtacttgctaaaagcactaaatttcatgaaatcatcatatttttttcgagttaaggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaatgagtccctttaggataaaaataacgtaaattccgattaaagcgttcattactaccacgttcagctggcgtataagcatggcagtaataggtcttaattccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattggtcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccttaagggtacttattttcacaattaacttgctagtatatttggtgagcccactagcgaagcaccaaagatcgaataaataataatgattaggatgatgaagaatgagtcaaagcttatggcaacgattgtttaatcaccgtcaacaaacgaagcaggccgtattaattcttgggagtggccgttccggaacatcggtaatgactaagtgtgttaatttgatgggcatttctctcgggactgataacctgctggcacctagtaagcggatcaatccgaaaggctattttgaaaataaagatgtcatcaatattcacaagtcacttggaagtcgcatccggtaccggccagccttcaagggttactatgatagcccgaagattaaaaaggaccgggcggcgttaaccacgtatctacgaaacttttttgagaatgaacagtatctggcgataaaagacccacggatgaatgattatattgaattgtggcaacgtgttttggctgacgttgaggttcagccggctgaaatcgtcttgctacgtaatccgatggacgtggtcaattcgaatgagcgcgcctggcaccgtgataccacgctcgcaatgcgtcagtggcaagtccggacgttgctttcattgcgtgataccgactgtgagcaccgcattttagtcacgtacgaagatttgtttggtcagacgttgacgacgttgaaacgaatcgcgacccaatttaacttaccgtggacgagcgacgaggcggctctccaagcgcaaatcgatgacttcatcgatccagcactccaaaagagtgatagcggtgaaaatttagctgattttgaagctcgaacggacgtggaacccgatgttaaggcactttacttactaggccgtcaagctgcggctgacccggattactttgcctcggctgaatttcaacagcgcatcgacgagatgactgacgagtatttagccaagtatggcgctttatatcgggactttaacgtcaagatcaatagtaaaacgttctttgtattcggcgaagatcaggaccaagtggatcaggtcaacacgactttacgaaatggtcaagtcaagatggtcggcacagaagctgacagtcatgaggttgctaaagatttgagcgaacggttgaataataatacgattgccattcagacgtatcccttggactatttagtggtcgagcaaaaggaagccctgaacaattatctccgtaaaaacgcgaaacgcgagacgttatgggggattggggatgctaaaaacaatgaaatcgttgaaatgttaacgacggtcagtgccgagttaggtgcggatacgcataacgtggtgattgcagatgacttaacggccatcactgatgaacgtgagcgccgattagcgattcaacatttaatacggacgttgcacgcggttgaacagccaccatacttggtcctgatggctgacgaactgggaacccctgcgtcgcaaagtgcggtgacggcttttattgctgctgagccgaccaaggcagcgccattacgagatgaacagccggacgaaacgttcaagctgcggaccccgctagacatggatgaggtggcggcaactttaacagcgttgtgtcgacgtgcgagtcaggatgaacaacagcaagccgcattgaaccattttgtaagtcttaattatgatgaaattttaaacgtgaaaggtgatcaatatgcaaacagtgtacggaattaaagctcatggtggtaagttagttaatttagaagattttagtgaagcaacgcgtcaggctgctgagcagctgccaagtttaaccatcaataattgaaatatctccgacttggaattaattgggattggtggttttagccccctgactggcttcatgatcagtgatgattaccattcagtggtcaacacgatgcacttgaagagtggcgttatctggagtgtaccaattacgctgggtgtgtcccaagcggatgctgataagattgaattgaatactaagattgctttgaggggcgctgacggcgtcatttatggcacgatgcaagttgaagataagtttgttccagacaagcaattggaagcccaaaacgtctacaagaccaccgacgaagcccatccaggtgttaaacgtttgtatgccaatggtgacgtctacttgggtggcgcaattaaattgttgcataagccagatcatggtgcttttagtgattattatatggaaccattagaaactcggaagatgttccatgacctcggctggaagcggatcgttgggttccagacacggaatccaattcatcgggcgcatgaatatattcaaaaattagctttggaaaacgtcgatgggttattcttaaatccattggttggtgagaccaaggcggatgatattccagcagacgttcggatggaaagctataagacgattctgaagtattactatccagaagaccgtgttcggttggtcatttatccagccgcgatgcggtatgctggtcctaaggaagccatcttacacgcaatcgttcgtaaaaactatggttgtactgactttatcgtcggtcgtgaccatgctggtgtgggtgactattacggaacctatgaagcccaagaattaatcacttcggtcgaagatgagatgggcatgcacttcttcaaattcgataattccttctactgcaaaaagtgtggttcaatggcaacgcagaagacttgcccacacggtgccgaagatcacatctcattaagcgggacgaaggtgcgtaagatgctggctgatggtgttgtaccaccaaaggaagtttcacgtcccgaagttgcccgggtcctcatcgacgggttgaagcgtaaacgtgaacagcaacaggaggtctaagcatggtaaaatcagataatattacttggcatcaatcgcaagttagcaaggccgaacggcaagcgctgaaccatcataagagtgtggttttatggtttactggcctgtccggttccggtaagtcgacgattgcgaatgccgttgaaaaagcattatttgaccaacaagttggtagttacgttttagacggcgataatatgcgctttggcttgaataagaatttaggcttctcagctgaagaccgtgaagaaaatattcgccgaatcggcgaagttgccaaactatttgtcgatgctggcgtgattacgttgacagctttcatttcaccatatcggaccgaccgtgataaagtgcgggcgaaccttgaggtcgatgagtttattgaagtgttcgtcgacacgccgcttgaagtttgcgaacaacgagatgtgaaacaattgtacgcgaaggcgcgtcgtggtgaaatcacgggctttacaggcatcgatgcaccatacgaagcacctatcgatcctgagattacgattgacacgtccaaacaaccactgaccgcttccgtccaacaagtattgaattacttggcggaacaccattacgtcagtttggctactgcaaatgaaaactagtgcaatcattactgccatcacaaaatcgattgtgaaaatggaccgaatcttggtctatcgtcatacgaatccggatcccgatgcaatcggggcacaatttggactagtcgccttgctcaaagcggcttacccggagaaactcgttgtggcgatggccccagttccgggccatttggcgtggatcgatacaaccgatgagcagttagtgaccccccaagcaacggacttagtcattgccgtagattgtgctaaccatgagcgcctagctggggagttgccaacaggtgcctttgtgattaaaatcgaccatcacccgaatcacgatccctatgggcaactgaactgggtcgatgaagcttatagcagttgctcggagatgatttatgagttggcgcaagcggggtgctttacagtgacggcggccgttgcaaccaagctatatgccggaattatcggtgatacggtgcgcttttcaactcctgagacgtccactcgaactctgaagattgctagtgcactcgcggcaacggacattgatattgccactattagtcaccacgaaatggacttaacgccagcactcagcaagttgtatgggtacgtcctgagtgaacaaactattgagccaagtggtctggcacacgttgtcttaccgcaacggctatttagtgacttgagtctggaatgtggcgatgaggatgcgcttgtcccgttgcccggtaacctgacgacggtcaaagtttggttgttcttcattgaaaccccacaggggcaataccgcgtacattttcggtcgaaagcaatcaatgtcaatgcggtcgcaaaagcgttcaatggcggcggtcatccgttagcaagtggggcatttgttcctgacctagcgacagttggacaagtcattgagcaaatgcaggcgcaaatattagctgcgacggccgtagattgagtataataaatttaatataaactgcactgattcggtttgacatggcaattgttagtcattctgtgtcggtcacgtgggttgccacgggaaggttagaccgccagtatcagcggtatgagcctaatattctggctgacaaaacgggcatatcgttggagtagcagtcgtgaggaattgattggcgtcagaaaaaatagtgagatagggtcggtgaaaggtaaatgaaaaagcgaaattggttgattgcactaattgtcgttgtgattgtcgcgattggcggtggttttgggtattacaaatatcatcagtcaactgcaacgacaacgaccactagtaaagtacgttcggcgagtgcaacgaagaaggacatcaacacgcggctagtcaagactgagattaagacccagtcgagtgagacggcgacgctgaagaaggcggtcgccaataagaattataccgttaataacatgtacacgaaggttaacccatacggggtgtctccgttatccgccaaggtgattttccagacgagcaaggcggccaaggtcagttatacggtggtcggcaagagtagtaagacttcaatttctaatacggtcaataagtacacaacgagtcatgatttgaccgtgctggggttatacgccaacacgaataaccaggtcaagattaaggtgacttataaggatggcacgtcgacgaccaagacaatccgactgaaaacggcgaagttaccatcggcgttgaccgattttaagatcaacgttaagaaggctaacaaacaaaaaatggtcttagggactggtaattcgaagctgacatttatggttcggacgacgatctctgggagcaagcagtctaaaaacttatcgttcgggatggatgcggatggtaatattcggtggtatacaacgcggccaacttcccacattttcaaacaacttaacaatgggcatttattgatttggaccaaatcgaatgctaagaattcatattttgatgagttagttgaaatggattatacgggtaaagtttataagacttataaatttaatcataaggcctggggtaaggctaagggttctaagaagcagaaccataatcaggtccaccatgacgtaacggaattgccaaacggtgatctgattgcgaccgtttccgatggcggccggacctatgtcgaagacacgatgatcgttatatcgcataagacgggtaagatcaccaaggccatcaacatgaagaatatcctacctgcgaagttctatacgaagtacaacgcgacgaagtccagtaaatatatgggtaagaaggactggttccatcagaactccgtctattatgataagacggataagagcttgattatttcaagtcgcaaccagaacttagtgatgaagatcgattacaagactgaaaagatcaagtggatcttgtctggtaagaagacttcagcttggccgaaatcgtaccgcaagtacttgctgaaggctagtggtaagattgcttggccgggtgggcaacatgccgccatcgttgatccaagcaccttgggcaagaagaactcgctcaacgtgatgatcttcaacaataacgtggcagttggtacgaccaagaaatcgttggcggactcttctggtaaatattcagaaggtgtcgaatatcatattaatgaaaagacgaagacgatttctcaagttggcagttacggcaagtcattaggtaagaagaactttgccaatattattggttctaatcgttacttgagtgcttcgaatcggctaattgattttggttggttgaataatggtaaatcagctaatattattgaatacgatttgaagagcaagcaacaggtgtttaacgttgaattaacgggtcttccaagcggtggttatgtctaccgggccgaacgcttctcgttgtatccgacgaagcacacgtatggtattaatgaataagaattgaatgtaaaacgggcgcccctgactagatggctcatctggtcgggggcgcctatttgcgtgttgcgctaaccaagatactgatggcgcgatggtcgttagtagcccggtatgaaaatatggctcaatggcggactagtcataatatcggttgatcaataactgcggataatgattgccggttgactagctaggcgtcacttttgaatgcttgataatcaatatttcgtcatccacacgacttcaagcgcgtccgttcttaaaccagttgtcggcccgaaaaggtcgttttcaaagttgtgactggatgttaatgaaaaagtcacaatttggtcgcaaaatcatccgcaaaagctagaataatttcataccgtgtcgcatttatgttcacattccaagtctacaatggttcttatgttgaacggcgcgacggatataggctgattatgagcagtggcgcaagactcagcaagatgaaaattagttgaagcggagcgatgacgatgaccttaaatattgcaattgttttaatcacgttattagtatcatttatattaatggccatggaagttacgaccccgaacgccgtaatcttgtgtgccttagcgttcttgatgtttgtcggcatcttgtcgccaacggacgcactgtcaggttttgctaacgacgggttagcgacaattgccctgatgtatattattgcctatgccattgccaaaagtaatattattacccgcttatttgaccggattctcggcgatggtcacagcgaaaagcgttccttattacggttgctagcgagcgtgagtgtgatttcaccatttatgaacaataccccgattgtgtccactttgacaccgatggtccagcgttggacgaagcagaaagggatggcaatctcaaagttcttgatcccactatcctacgccacgattctgagtgggttgttgaccgttctagggacttcgaccaatctagtggcacaaggattattgtctaagtacaaattagcacaatttggtacctttgacttggccgtcatcgggattcccatcacgattattgggttgatttacttactgacgatcgggtaccgcatgttaccgacctattatgggagtagtgttgacgatgttgttgctgaaccgaatgattacttgattgaaatgacgatcggcgatgagtttgaacacctcaatcaaacggtggtcgccgccaaacttcgtaatttgccgcgctctttcttagtggcgattaatcggagtggtcagtcgatcgtgccggtgacggatgagacgattctacagttaggtgaccgtctttacttcactggaaattttgattgtattaatgatcttatgaatattaaaggtctaataccaagcactcagaaaatcaatatgactgatatcaccaatgaacgggttcggctcgtcgaagtctccattccggacacgtccagtttggtgaaccaaacggtcaaatcagcgcgttttcgcaatgtctttgggagtgtcgtcgtcgcaattcgacgcaacgatgtcaacctcgaagggcatctcggaagtattcgcttaaaaggcggggacaacttggtcatgattaccactggtgaaccagacgagctggcaagtctcaaagatttacacgtctttaattcacaaccagtgaagtcccggaaacatacttataaggatgttttaccgattgttttattggttgcaacgatcatcgtgtcgactatgggcgtgattgatttgttcgttggtctggcggcctcgtgcgtggtacttttcttgacgaaatgcgtttcaatcagcgatattgtgaaggctgtcgatatgaacgtgttgtttttagtggctagtagttatggacttgggcttgcgatgtcgaacgtgggtgctgataagtttatcgcgaagtcattggtagcaattaccgggaatgcgtcaccaatcatctatatgttcctgatttatttcgtgaccaatttcttaacggccatcttgtccaatgcggcggcgttatcactgatgtttccagtggtcgtttccgcagcaaagttggaaaatctacccgtgatgatgcttgttatgttgattacgattgctgcgacggcggacttttcaacgccaatcgggtaccaaacaaacttgattgtttacggccctggacattataagttcacggactactttaaagtcggaattccgttaaatttgatttgtatggtcgtttgtgtgtttgtgtcctattactattatatggtgctgtgatgtgacttaatcgaatctaaaagacttgtgagcggctgctgacaagtttttttgtgttggttagtaaatcggtgacagcttagcacagtgaaataaccttaaaaagtaaatcaagacggccaattcactaattaaaataaaatatttaatatttacgaacaaaggactagtattataaatctaaagttgatatactagcaaagtttgcttgtctggcaaagcaccaagaaaacgattacaagtacgtcatcttaattaatgaaaggagtgcgaaaatgaacgatttaacaaagggaaaaccgctaaaattaattttttggtttacgattccgttactaatcggtaacatttttcagcaattttatagtttatcggacacgttgatcgttggtcagacgttaggggttaaagccctagcagcagttggatcaactgggagtgttcagtttttgatcattggctttgcgcaggggttaaccgctggcttatccatattaacagcccaacattttggggcacgtgattttaaagcggtgcggcgcagttttgcgattagtatcgtagttagtctaattgttgggattattttgacgattctgtcgttgatcttcgttgaccatatcttgttgttaatgcaaacgccaacggatatcattgcggatgcgcggacattcttacaaattatgcttggcgggatgctggcaccaattgcgttcaacctgttgtcaaacatcattcgcgcactcggtgatagtcgcacgcctttatggtttttgattatcagcgcgttaattaatattggcttggaattgttattcattttggttttcaaatggggcattgccggggcgagctgggcaaccattttagcacaaaccattgcaacgctcatgtgtgtggtttacatcatcgtcaaagtgcccatcttgcacattggacggcgccacttcaagttagtttggtcggaagtgaaggctcacctgaatgttgggttacccatggcctttcagatgtcgatcatcgcgattggaacgattgtgttacaagcggcactgaatagtcttggcactaactcagtggcggcgacgactgccgctcagaaaatcgaccaagtcgcgactcagccattaatgtcttttggggtcaccatggcgactttcgcggctcagaattatggtgctcatcagtatgaacggattatcacgggagtcaaacagaccatgtggctgtcggggagctttagtgtggctgccggtttgattgaaattatttggggtaaacagcttgtggggttcttcgtcggtcatcaggacatggcggtattgaacttatcccagacgtattttaacgtcatcgggagcacgtatatcctattatcaatgttatttattatgcgtaataccttgcaagggcttggacgcagcgcaattccaactttggcaggcgcggcggaactctttatgcgggtgtttgcagcactgatattagttcggatcttcgattacgccggtgcttgtagttcggaaccgttagcttggttagggtcgtgtgccgtgcttttgcctgcttatattaaatcagtccacgatttacgacaacaggcccgcatgacaaacacggtcgcagaaggggccgaaccaatattaaacgattctgaaaaattgtaattaaggcttgcaaccaagtggattatttgataatatttgttatcaattttattttaaagtcactcatataatctcccggacacctgtggacggggcatgaattgaaaaacgttaaggagtttacaaatggccgtagaattaaaaattggcgattacgtcgctggtaagaagtttgcttcgttggaacatgatttcaagggtgaaattgaaaaagtgtatgaaaattcagtcttgatcttaattaaggaatttcaaaaagctgacgaaccaattgttaacgagtataaccaccgcgcagttgttcgtaaggatgatgctaagctcattaaagcggctccaaagccgaaagtcgtcccagaaaaagaagactaaaaatttataaataaccatgacaacagaaaaaatgtatgctatactaatttctgttgtcaaatgcgggtgtagtttagtggtaaaattcaagcttcccaagcttgcgtcgcgggtccgattcccgtcacccgctttgctattaatcatttcggttagtagtcattgtattctcaagctccttgagcgcatggtccgttggtctagttggtttaggacgcctgcctgtcacgcaggagatcacgagttcgagtctcgtacggaccgtcaatagatgatgataatcaagaacgttagtcagcaatgacccgttcttttttattgagtaaaaatcaagatgactaaatagttgaccggatgggtgatcaacagtaatcgttaaggagcgcaaatgcaatttataacaacatctttcgatgagttaactgttcggcagttacaacagatttacaagttacgagtggcggtttttgtcgtcgaacaggcctgtccgtatcaagaagtcgacgatacggacttgatggcttggcatttacgagggctggattcaacgggacagctgctagtatatgcgcgattaatgcgtgaagccaaccagcaggcccgtatcggccgggtgatcaccaatccggcggtgcgggggcacggctacggtcagcagttgctccaacaggcgattgtgcagattcaagcgttgtggccttccacgacgcaaatcaatattcaggcccagtattacttagatcgcttctaccgtggatttggttttcaaccagtctctggcgtttatttagaagatgggattccgcatcagaatatgattttaacgttgaactagtcaaaacggctgaattctgttatactaacgcatggtaaaaatatatacgtctaatgagaaagaatagtacgatgaacgtttagaccagcgagttcgggatgatggaagccgaatctaaacattattggaagcgcgcttttgaagacgacaattcgataataagtggatgtcatatcaattagagtggtaccgcgggcacgtctcgtctcttacatgtttttaaatatgtgagggactttttttgtcccgtaagacaatcaaggaggacaatatggattataaacaactcgtcgcagcggccttagcgccagcactaccagatttaacgcaggaagcgattctagacaagatcgaacaaccaaagacgtctaagcagggggacttggcctttccaaccttcaccttagccaaaacgttacacaaggcacctcaaatgattgccagcgacatcgtcgaaaaagtcgatggcagtgactttgaaaaagttgttgcaatgggcccgtacgttaacttcttcttcaagaaggatgcgtttgcagccgatattttaaatcaagtgttgtcgaatggtggccattttggtgatgctaagctcggtgaagcgggtcaagttcccatcgatatgtcatcgccaaacattgccaaaccaatctcaatggggcatttgcggtcaacagtgattgggaattctttggcaaatattttaagtaagttggattaccaacccgttaagatcaaccacttaggtgactggggcacgcagttcggtaagttgatcacggcctacaaaatgtggggaagcgaagctgaggtcaaagctgatccaatcaataacttattaaaatactatgtacgtttccataaagaagacgtcgatcatcctgaaatggatgacgaggcgcgtgaatggttcaagaaattggaaaatggtgatgaagaagccacccatctgtggtcatggttccgctcagaatcattgaaagcgttcaagaagatttaccaacgcttggatatcgactttgattccttcaagggtgaggccttctacaatgataagatgcaagaagttgtcgacatcttggaagacaagcacctcttgcaagaaagtcaaggcgccgaagtggtggacttaagcaaatatgacttgaatccggcattgattaaaaaatcagatggcgcgactttatacatcacgcgggacttggccgctgcgatctaccggaaacggacttatgatttcgtgcagtccctctacgtcgttgggaatgaacagaccaaccactttaagcaattaaaggctgtgttgaccgagatgggctttgactgggctgaccagatccaccacattccatttggtttgattacttctggtggtaagaagttgtcaactcggagtggccgggtcatcctgcttgataaggtcttggacgatgcggttgcgttagctcatgaacaaatcgaagccaagaatccggacttgcctaacaaggatgaagttgcggatgcggttgggattggcgctgtggtcttccatgatttgaagaacgaacggatgaacagctttgactttaacttggaagaagttgttcgtttcgagggtgagactgggccatacgtgcagtacgcccatgcacgcgctgaaagtatcttacgtaaagctggtagcccagaaattgcggcaaccgagcaaacgttaagcgacccagccgcttgggataccttgaagttattgagtgaattcccagcgactgtagtacgtgccagcacggaatacgaaccatccgttattgctaagtatgcgatccacttagccaaggcatacaacaagtattatgctaacaccaaaatcttagttgaagatgatgaattaaacgctcgtctggctttggtcaagagtgtcagcatcgtcctgaaggaagcccttcgcttacttggcgttaaggctcccgatgaaatgtaattagaattaattaacaactgttcaaatttgaacgccacgcatactaaaccggccgttaaagccgggcgagaatgcgtggcgtttttttgttgcggccgtagaggcacggaactcgatatacaaccgatggcgaacgcaagttgtgaaccaatcgcagaaatcgcaagtaggtagcggaggcccactattgtaactggaaccagacttatcgtgtgaagtggattatcagtcgacggatcaaggctttaccgccccggccgagtaaaatgatcccgatcaacgaccaagatagtaacaataggcaaccatgaatgacaaaggaaacactgatcgatatcatatcgtcacgatattcattttgagagagcaacatatcacggctactgacgggattgacggcgttatgataaatttgagtgattgtttgatgttgaccggtcgcatcattcaaggcacgtgaagcgactgaaatcatttgaaaagggttatgggtaagtcgtggcaataggcacattaggagtggatggccgaagaagtatgcagaagtcagatagaggttggttaacgtccaatgtaggtgaaaacggccgctgggatctgcggtgacggcataaaaagcaatcacgaaaaaaatcgcgcaacgaatatagtcggaaccgattaagctgaaagcctttttcatggttatccctccgtttgaggcttggctgtgttttcttcagataaatgctcaaactgggttgcgggcgtcgtgatgcttacaaatgaccgcccatccgagttagtgaaaccaagcatgatttatgtctgattataagtcggtgtgatgatcgaaacaaacattaaaatcttaataaggcaacttccaatactaaaattttaatgacctgtttagtcgtccggggtggtattctgaaaactaattcaaaatgccatattgggggcttggtgatgagctacttagaactaacaaatatttgtaagaactatcaggttggcaaacaaacattcaacgtcttgaaggacattaacttgcagtttgaactcggtgagtttgtggcgattgtcggtgaatcaggtggtggtaagacaaccttgatgaatattattggaggactagaccatgatttcacgggaaccgtcagtatcgctggacaaccacttgattatcatcatgagcgccagctggatcagtaccggcgcgaagtcattggctatatctcacagacctacaatctaatcggtcatttgaccgtgcttgagaatgtcatgctagccttagatatgactaaattaagccatggtgaccgattgcgacgggcacacgagctcctagcaaacgttggcttgacggcacaaataaaaaaatacccgcaacaattatcaggtggtcaaaaacaacgggtggcaatcgctcgagcattagccggtgatcctaaaattttgattgcggatgagccgactggtgcgctggatgcagacaataccgccgatgtcatggccatgcttcaaaaaatcgcacgggaagggcgcttggtgatttgtgtgacccattcacagcgcgtggcgggtgcggcgacccggattgccgagttggtgaatggacgaattaagtcacaaccagtgaccacccaaaatgtcggcaccacgcaaacagttgcgtcactacctgcgcggccactttcgtattgggtatcagtcatgatggccttcaagcatatgcggcatacgtggatctggaatacgctaattgtcgttggcacagcgattggattattcgccgtcatgcttttcaatggtctggggaccggcataaaagggtatattaaccacgaaatgaatgcgttggtggacccacaatcaattatggtcatgcaccaagcggataacgcgaaggatcgtgatgaacaggctgcggccgtctatgatccagctgtagccggcggtatcgcagcccggatgccggtgttcaccgactcacaactcacagcgttgcgtgaccttaagcacgtgaccaacgtggaacccgggatttcagctacaaacgcaacgattgcgattggacaacaaaagtatgccgcacctgaactgacgacctggacgagtagtgatccgacccggcagttgaaagcaggccacgtggcgggtgacaatcaaatcgtattagataagtcttcaatcgcgcagaaatggtcggcaacgcgttggcgtcagttagtgggtcgggctgtgactgtgagttatcaaaccttcaatcaaaaagggcaacccgtgaccgtggcgcgcgtgttgacggttgctggaatagtagatagtacctctgaggtcggtttgaatgcagttaactacaccacgatgcagtcgatgcgttcagcggcacgtgtctcaacacaaccaacgtttgtgagcgttagaattaagagtcgggtgcaaaatcaggtcgtggtcaatgaaattaaccacttatcaattaatggcaagcacccatttgccgcgactagtattgcggccactttggattcgttcaatacttacgttaatattgccactaaagtgttggcggcgattgcggggatttcattaatcgtttccgcattaatgattattgtaacgatgttcatgtcggtcagtgctcggatgcgagaaattggtattctgcggtcgctgggggagcgccggcgtgatattcgccggctatttactagtgaagcgctgatgttaggcattatcagtgccacgttagcgactgggctgtcctatttagctgaacgagggctcaatcatggtctggctaagctaactggcgggtatgcgctagttcagattcagctcggcaacgtaattgcaatttttgtaatcgcaattattatcgcctggcttgcggctattttaccagcaaggcgggctgcgcgggctaatccgatcaaagccttggccgctgaataacaagtgattggataattgtcgtgatggaaaagttatgttaaccagtcaacttgtttgaaggagtggttaaaaactgtgcgagatgtcgcaaaatagtcgttttattcaggggtgggggtcattaattcattagggctggtattaacgacagcagccagttctaatattggctcgcccagggtacgcagaaacttctgattgagaaaagtaaattagctcggctaggttctgcgttactagtcgagctaattttgattaatatcttctggtcttaggtaactggggatggttatttggcagttagcgtgtacttgagacgtcgatgatggttctttacaaaccggtgctaattagttaattgacataactaaacattattagtaaaaactaatttttgagaagataagtagcaatggcgaaattcaattgtatccgtttaaattgattaccatacatgttggcgcttactttttatggccaaaaccgtgtcttgtcaaccctatgcagaattaatccatcgcccacttgacttattcaacgggtgaattaattcgccaacaaacttatcagtgacttctcataaaaagcccaaagtcccccctgttatacatgcaaaacactagtaattcagcgactgtccgggtatgctgttggtgtaaattaagctaaggagggttttgttttgaggaaacaaccacagacactagtcattggtggaacgcaggttgctagtggcaagagcttgttgacactggcgttagcgaacgtattgactaattggaaaatgacggtcaccatcgttagttgcaattatcaaaccgttacgtggcggaccattcaaaagcatcactgccatgagtggcagtcagatattcgaacggctaacgagctcaacaacttttggatagcgttgcagggcgtccagacggattatttattgatagatcttgattctacgggtccgaaacacgataactatacttggttactcaacgagtgctggttgccattagcgcaacaaattattttaacctattcgactgaaacggatgtcaacacgttgttgtatcaagatttaggggccttacagtttagcatggaatacacactgaccaatcctaaaatctacaccgtgttgaatcgttatccagcaccagtagctgttaggtcagcgatgacggccagtgacttactcccattccatcgtcaatttcaaactcggcacgcagaatttgctgcaatgaatttagagccattgggtatgttgaccgacgcccgccagcacccagaaaaagttttggcggatgccacgcaaattttaaccaaacttgtggcgtaattatggctaattattgatcaaaacgacacgcgctgtgatgagcaacgggtgcttttttgcgggtagtgtggggatgggcagcttaaaacgttaatctgtccctggcccgaatcccgaaggactctttctactggtatcagcgagtgattgcatccaatggtcaagatctgggtccctcggcctcaaattaaatgactgttgctcagcagttttcgtcgatatcggatgaagactgcttttggttgttcaataagataattagccgcgtcaaacaaaacaagaggataccaccaccaagcaaggggagggtccaagaaccgagcattaagatcaaacggggtgctagcaaactaccgataacggtagtggtgtcgatgacggttaagacccccgtcattagagtattacgattgtttgtggggatttgttggatagtggtgaaaaaactaatgttggtctgtccgcgtaatgcaccaattaagaacatggtaatcataagactggcaaaggtcggccacataagtagtaagcacccaccggtgaaggccgtcaaagttagcagggattgctttgaccatcgttttagcaatagtggtgccaataagatacctgtggcgttagctgttaagaaccagctaagtggccagtgactatgcaacttgctgacgacgagccaaggaacggctactgcaatcgtcgcgtcgaccagataaccgagaacggcgtacagtaacgaccatgtcggccatgatcgatggcggtctagcttgacggtgacaaccgaatccgaggagagattggaacgtgttcggaattgccaatcgaggccgctgaaaccaagaacgctatccccattattaagattagggtagccggtgttacccatagtaatgccatcgtgacgagcattgtcgcgctaacgatggccaactggcgaatctgagtttgatagccgttgacgatttgaatatttacgggcgcaaaaaggtctggcaaaatcgttttgttactgagcttataaaagaccccaattgatttattaagaacggcgacgatgactaagcaagtgatttgccaactaaccgtatttagtgcgtaataggcaccaatgaagagtattcccgtcaaaatatccgtaatgaacatcatttgtttggctgagtagtatttaagtacccgaccagctactaggttcagaccgattgccggcagcattgtcatcgccatgacgttgccgagtaactggggatcaccggtcttttcaatcgttaaccaggtgactaggtaagtaaagccatagaagccaaaaaaggtaattaacatgctgctgagatagcagagtagattatggcggtcgttaggatgtggcctaaattcttttttcattaactgacaaccaccggtgtatgggttgaaatgttttcatagagccatttggcatcagcaatcgtcagacgaatacaaccatgtgaattggcgactttaccaagttgctgggcttctttaacgatgtattgatcgttagcatcgactgggactgaatgaaataggtaaatcccatgatccttgaatgagacccagtaattggcgccttcacccgattgcgtgttaaaaaagtgttgtcctcgttcggcttggatttcaaagtgtcctttgggggtatcagagccatgtttgcccgtagaagcaagcatggtataaagggtctgatcgtggttttttaagtagacgcgctgttttttgattgaaacctgaatgttgatgtcatcgtatttagccagtttgggatacggccgtgacagggagggcttgtgccagtcaacggtctccgggactggcgtggttaccttagttgctgaatgactaactttagtgattggccgattactggcaatagcctggtggtgccgggcaaataggtgtccgaatccggtaaaaatagttaagctaattgcgccaatcgtgacccagatgagctgatgaacactgattttcaaaataccatcccttacaaaaatgattttagtgattttagtttactcagttagcgaacgtttgtttatcaaaattgtgtaaactttgcatatcattttcgtaaaattttccaaaatgagttgtgatagccattattgctggtgccacgggtaatgtcggaaatcggcaaattaaagttatttgcagtaaatcagctgttaaggtagattgtaaaattaatccgaacgctgttcggacaaaaaagatcagcttcctttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaagtggcccaaacagatgccgaatacaagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacgtttcctttgggcctaccgattaaaaaaccggacagcaggaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccttaattagacaatttttccagctaattaaaaaatcgccattaagcagcgtgcttaacggcgatttgaatttttatttattgtaaactagcgaccttagctacgattttagcaggcgtttcccattcagaacgttcaaattcggaaacgggcacttcaataccaagctgattttgaagttctagtaacagttgtacggaacccatggaatctaagataccttcatcaaataaattggcatccatattgtttgaaacatcttccccagttaaatcttgcaagatcgatagtaccgttgctttaacatcatccatgatcaaaatacgccccttatcattattgtgaattattcagtcttcattctagcatagttttatcatcgatgatggttaatcaggtgtattaacgaaatctttacttgattaaacgttaaaattggcgtgaattaaatcagttaaaattttaatcccctgttcaaagcgatcgctggattcataagaaaagctcagacgaatgtactgattcggctggaaatcgtagatactaccagggttgaagagaacgttgtgcgcagtggcaaggtcgaataatttgggaatattaatgttgtcggctaagcggacccacagataaaagccacccgtgggcgtctgccaagtcgcaaaatcgtcccagtaatgatgcagaatttgttctgccgccgcggccttcttgacaagtacggaccggaaatcagcttgatacgtttcatattcaggatcagctaagatttctgccagtacaagttgtgacagtgagctagcgccgtaatcggtttgcatgcgcacgtcagtcaagcgatcgatgaccggtttggcggccaccgtccagccgatgcgtaatcccggtgcaagggactttgagatgctaccaaaataaataacgttgccagtcttatcgagtgccttcagtggctgtggcggctgctgatcgaaccagacatcttgataagcggcgtcttctaagattggtaagcggtgttcttgtgcggtttgtaagacctgttgacgtcgctcggcactcatgacgattccagtcgggttattgaatgtcggaatcgtgtaaagaatggcatggtgtccctgaatgggggcgttcatctgccagtacgccaagccctgactgtccatcgggatgccagcgagatgggtgtgggccgattgaaagacgtgtaaagatttgacataagtaggtgcttccgtgtagatggtggcatctttgggaaatagtgacattgagaccagttggagcgcttgtaatgatccggaagtaatcagaatgttttccggatgggtatgaatcccaactttttccaagtgacgtgcaatttgttgtcgcaaagccaaaatgcccgcaggctcggtatagttcaaactcgttaactgttcgcctagatgtgcaaaggcccgttgaaaaagtggacgaggaaattgttctggtgcgggttcacctgtacttaaacgaataaccgcatcggtttcaaattggttgattttttggagcgcgtgggaattgggcttgaattggcctgctttaacatattgcgaccagttgacgtgttccgccaataagctggaccaatggttaccggaaataaccatcccagagcctggattgctcgtaattaagccgactgccattagttcatcaagtgccgtaattagggtgctacgattcacgccgaattgttcggccagcttacgctgcgcaggaagcttagccccaacggcccaattgcctttagcgatttgttcttgaaaatagttagtaatttgttggtaaattggtgtgctgacctgtttatttggttgccagttgatcgttaaaattgccatggcaaacgcctcctgagtgcccatgcgggcgaattaagctgtcattctactagccagaagtttgatgattgattcaggtggttgggtgaaaattgttaaattggttggctacaaatgaaattatctctattataatcatctctgaattaaaagctagtcggatatgaccaattgattaaacgataattggttggtaaaagaatcgaattggctggtattaaggaggtcaaaaacatgcaagtgtttttacaaggattattatttggaattgtttacattgcaccaatcgggatgcaaaacttatttgtggtttcgacagctattgaacaaccattgcaacgggcattgcgggtggctttaattgtaattgcgttcgatacgtcgctttccctggcttgcttttatggggtgggccgattgttgcaaaccactccctggctcgaattaggggtgttgttgattgggagtttattggtcttttacattggctggaatctgttgcggcaaaaggccacggtaatgggggccctcgacgcggacttttcatataaagcagcgattctgaccgctttttcggtagcatggctgaatccgcaagcactgattgatggttccgtgttgttggcggcgtttcgggtgtcaatcccggcggcactgacccatttctttatgttgggggtcatcctagcatccattatttggttcatcggtctgaccagcttgatcagtaagtttaaacatctcatacaaccacgagtcctactctggatcaatcgaatctgtggcggcatcattattttatacggcgtgaagttgctagcaaccttcatcacgaaaatatagttgcggttacctctgacaatcggtatgctagtcgtattggactttttatgagagggacgatacgcatgaagattgctggtttcggagtggaggcctggttaaacgcacatgagcgtgaagcaaccaccgatattagtcaaagctcaatcgcagccttaacgatggcagaaattgcggctttagacgaccaacaagcaccacaggatttttacgaagaactaggggcggcccgactggattatggctggatcgagggctcaccacgatttaaagaactcgttagtcagttatacgagcaagtgccagcagccaatgttctccaaacaaatggggcgaccggggctaatcatttagcaatctatagtttggtggaacccggcgatcacgtgattgcactgtacccgagttatcagcagctgtatgatattcccaagtcattgggcgctacggttgattattggcatattcatgagtcagcgggctggttgccggatattatggaactgcaacgcttgatccggccggaaacaaagatgattttactcaataatgccatcaatccgactgggagtttactagatcgaacactgttagaacaggtcgtcacattagctcgctcagttggagcttacgttttggccgatgaggtctacgaaccactggatgaaaccccgttcgtctcaattgccgatttatacgagcgtggaattgcggtcaacagtttatccaagacctattcagcgcctggtatccggatcgggtggacggcgacacctagtcaagccattgctgatatttttcggaagtatcgtgattatacgatgatctgtgggggcgttttgaatgaccaactggccgttagaattttagcgcaccgccaacgcgttctggcgcgaaatcgggagctagtcagtcgcaacctcaaaattctgacagagtgggtcgcacaggaaccgcgggtcgaattgattacgccacatggcatttcagtgtcgtgtattaaactaatagtaccgatcgatgatgagacgttctgtcaacaattactgcgggataccggtgttttattagtgcctggttcacgttttgatattccggggcacgcccgcttaggttactgtacggatacgccgacgttacaacggggtctggatttattagggcaatatttacgccgctttgattagttactagtggactggtaaccgtggttgactcattacttttaaataattatacaaatttgtttaagcacattttcctaatagtggcggaaaatgtgctttttgaagttctgtgcgtagtttgccaagtgaatatttgctataatgtattcattacaagatttggggaggtttcgcgacatgaaaaagtcagagcgccaagcagttatcgaacaattaattagtgaatatccgatcgctacccaggaagaattgatggctaagcttaaagcagagggcattgctgcgacgcaagcgacgatttcgcgcgatatccgagagatgcagatcgttaagacgccggatgagcacggtcagacgcggtacgcgatttttaaaacaactaacaaaaatgaacaggaccggctatttgaaacgctacacgatgtggtgacgagcattgaccgtgttgaattcatgaatattattcatacgctaccgagtaatgggaatctattggcggcgatcattgatgatttgaacttgccagaagtgagtgggaccttggctggtcacgacacgatctttgtcgtgagtccgaatacgacggtggcaaagcagctatacgaatcctttgctagtcacattagtaatgaagactgactgtggtgagcagtctaattggttgcactaagccgtcgttcacggtatgattattgtcatcaaaagaggtgtgagatatgaaatatacgaagaaacgggcgcctcgaaagaatcaaaaacaacgcgatgcgaccttcgataaatttaaacaacaacaaaatgagctcaacgctaaccgccggggtgtccggcgcaagtaatggctgagctagctttcaagtatgtcatatggacggctcggaagctttttttgtttatggccgttttatcgtagtgacctttaatctggttacaacacgtggcctaaatcagtgatttcggcaacaactggcaaacatcgggttatctacaaaatgagttgcgtttgattgttgaagattttttcaaggttgtggtcaattactgagcatcggaaaatttatgatacaattgtaaaagctaacaagtaacgcggacgttgtgacaggtgcgtcggctgaacaaggggaagattatgcaaaaaaatggtttttgggccacgatcaaagacggcttacgagtcattggcaattggttagcaccctattggcagcgattcgctgccgtcgtcggctaccaatggcaccggcgacaaatcacacggtggctaattgtactcgtcttgaccgtcatcttaattgggagtgcctatttaacttatgaagccaagacggctaaagttggtaatttacaggcggagctagaaaagacaactgaaatctatgataaggacaataaaaaggccggttcactctattcacaaaagggaacctatgtccatttgagtagtatttcaaaaaacttacagaacgcggtaatttcgactgaagaccgtaatttctataaagaacatggtttctcagtcaaaggaatcgggcgggcatttgtcctgctcgttatcaataagatacttggccgtgactacattagtggtggtgggagtacgttgacgcaacaattggtcaaaaacgcctacctaacacaacaacagaccttctcacgtaagtttcgggaaatctttttggcgattgaaactgaaaatgtctattctaagggccaaattttagcgatgtatttgaataacgcttatttcggccacggtgtctggggagctgaggatgcgtctgaacgatattttggcgtacacgcgtcagagttgtctgttgaccaggcggcgaccttggccggaatgctgagctcgcccagtggttatgatccaatcaatcatccgaaagcgtctaaggctcgtcgaaacgtcgtcttgaataacatggtcgctaataataagctttccaaaagtgagtataagctttattcgcaaaaggcgatgacgctgacgaataactaccattatgaaagtggttataattatccatattatttcgatgcggtgattgatgaagcaattaataagtacgggctaacggaatctgacattatgaatcggggctataagatttatacgtcgcttgatcaagatgatcagacacagatgcaagattcttttaaggatagtacgttgttcccggccaacgcggacgatggtacgaaggtccaaggggcctcaattgcggttgatccgtcgacgggtggtgtgttagccgtagtcggtggtcggggcaaacacgtcttccggggctttaaccgtgcgactcagattaagcggcagccgggttcgacgatcaaatcgttggcagtgtatacaccagcactacaaaatggttatacgtatgattcgaacctttctaataagaagcaaacttttggggccaataaatatgcgcccaaaaactatgataatgtttatagtaaatcggtcccaatgtataccgcgttatcgcaaagtatgaatattccggcggtttggttattgaataagattggtgtgaataaagggtatcaatcggtgaaaaagtttggcttaccagttaccaagtcggatgataacctggcacttgccttaggtggtttgacgacgggggtatcacccgctcaaatgaccagtgcctatacagcgtttgcgaatggtggtaagaaaacgacggcccactttattacgaaaattgtcgatgctagtggcaatgtcgttgtcgataatacgaagactaagacgaagaaaattatgtccgccagcgttgctaaagaaatgaccagtatgatgcttggcacgtacaatagtgggaccggggctgcggccaagccgtatggatactcggttgctggtaagactgggagtacgcaggctgattacagtacgggttcgggaacgaaggatcagtggatgattgcttataccccggacattgtggtcacgacctggatcggatttgatacgacgaacagtactcattatttgaagagtttatctgaaaatcaactttcctcgttattcaagaatgaattacaaaatattttgccgaatacgaataatactagttttggtacgaaggatgctgcgacactggcgaccgaatctaatagtagtgattcggatagttccgatagtggatcatccgtatgggaaaacgttgagaagggcgctaatgcagttaagaacaaggctaaagactggttctccaaagccaaaagtttccttggcaactagtaaagctagcttctgaacgtactaatgctattcaagttccgttaaaaatgctaaaataatgacgacacatacttcgaggaggaactcacgatggccgtaaatatttacgatactgcgaaccaattggaacaagaattacgtcagactaaagaattcaaggaattaaaggtcgcttatgacacgatgaagaccaatgacagtgccttttcactgtttaaggactttcaagaagttcagatgcaattgtcacaaaagcagatgaatggggaagaattgacggatgacgaagttcaaaaggcccatgatttagctgataaggttggcaacgttgacgaaattaagtccttaatgggtaaagaacgtaacttgaaccaattgatgaatgatttaaatcaaattatcactaaaccagttcaagaattataccagaactaagtaaattaaggatcgaggggcaatgacggaatctgttccgtgattgccccttttttagtgggggttatcatgaaatttctacacgcggcagatttacatttagatacaccgtttcaaggactgagtggcttaacaccagctttgcaggaacggttagtgacggcaccactgagggcactcagccgactagtcgatttggcggtggctgagcaagtcgatttcgtcctgctcgttggtgacttgtttgaccaacagggccaaagtgttcaggcccaggcggcactgatgacggcgctagcgcggttgaatacggctgcgattccggtgctgctatcgttcggtaaccatgattttcaggcggatttaagtcgctggcactttccggccaatgtgcacgtttttggcccgcaggtaacaacggctaccttaacgactgcggcacaagaacgggtcgcgattagtgggtttagctatgcgcagcggtgggtgacgacggaccccgttgatgattatcctgttaaagccacgggcgttgattatcagattggtaccttgcacggtcagattggtgtggcgggtgaccactacgccccgttcaacgttagtgaattattaacgaaacattatgattattgggcacttggtcatattcatcagcggcaaacgctcaattcgcaaccaccaatcgtatatgcaggcaacacgcaggggcgccatcgcggtgaaactggggcgaaggggtgcctcattgtgaatagccaggccgatcagaccttgcaaccagtatttcacgccttgactgatattgaatgggcggattggacgccaacgctcactagtccagaacccatgtcccgttcacatatcgtccatcagttagctgatcaattatcattgaagatggttaccggcttaaaattagtaacgattacgttaccagctagtcttcaactgagtgcgatggcggaattagccttaaatcagggggccattctagcccagttgcaggaacaggcaaatgaacattggtggccggttgcgattgagcaagcaacgacggatacgatgacccccttgtttggtattaacgcgacgacctggcaacaagttggtgagcaggtcgtgaccgatcaagcagtcgctgaacttgcaggcaaactcttggatgaagactttctgaacactgcgttgctggaagatatgtcacccactgcttggcaacaacaagtggtgcgactcttaaatgatcagtaccatttaacgacgggggtgaatgatgatgcagattaagcgtcttgaaattgcgggctttggcaaatttcaacagcagcagttcgagtttggtgatgggcttcaagtgatttacggcctcaatgaaagtggtaaatcaacaatgcgggcctttattctcggcatgttatttggttttccctcccgccgtcacccacttgaacgccatgaaccacaaggtacgaatcagtacggtggttcgatagagctagtggttgacgagacgacataccggttgacccggttaggtgatcaacccgctaccttggtgaacgtgcagacgcaggccgctcaaccgctggccttacttgacaagtggttagcgccttatgatcgtgaccagtatttgcgattgtgtacgtttaaccaggctgaattgacggcgctcaaaactatgcacgccagcgatttgaacgtgcaattacaacaagtcggattggtgggcagtgcaccatggcgagaaacggcgactacgttacggacagatgcggaggcgttatataagccccgcggccgcaaacccaggttgaatcaagcattgcagcactatcgcatgttgacagaacaggtcaaggcggccaagcaacggtacccagaatacgaaacattacaaaatcgattgctggatttgcaggcacaacggacaagtacccaacgtgatttaaccaagttggatcatgaacaacaacagctcgccaatttacgaaatcagtggccggtctatcaacaattgcagcaactgcaagccactaatatgacgacgacactaactacggcgactaggacacgctatcaacaattaagccaacagcgaacggaattgcaacacgccttggcgagtgcacgtcagcaattaagtcagcaaccagttgatacacaatctcaaggactagttggcttctacgtccaacatcaagaccagtttgaccaattagaagctcagttaccaaccctgcaacaaaccttaggccaataccaaacgttgacccagcagggaagtgctgccaaggctgattttcaagcgcaaagtaatgcacatcctgagctgttaggttgcctctctccgcacaaacaggccgcaatcgagaccttgaaggcgacgttggcagcgacggcgaacacgcgtcgccaacatccggccccgaatagtccatcgcttgattggcgcttgattggtggtgcaatcgggattgtcgcgggattattgctaccattaggcggctttaaatggatcttgatgttagcaggtgtggccctacttggttggtttgggatgacccgtagtcagggtaaaccggtgcaagcaaccgaccacttatcagaccaattagtggctgctggtctggcaccgaatctgactgccagtgaggccttacagcaattggaactagtcgcggcactgcaacgcgcacaagctgcggtcacgactgctgatcaagcattagcaacccaggcggccaaactctggcaattgattcaggcttatcaatttgcggcaggatggattcctgttgatcaggatcatttaacgacaagtgttactcgaattgcccaattctatgatcaagtccatcaagtgatgcaacagcagaccatgtccggccccgactttgcctttgtccagcggcaggtccagcagttgacgcagcaggtccgtgatctgaccgagcagctacagtcgttagcaacgaccaacggtttagcggatgtagacgcgttgacacaagcggttagtgatgccgaaaagcaaacggccaacgccacgagtcgtcaacaattacagcaacaactccgttctgctgagctatcggcgttgaagcagtatacgtcgcttgaagcgttgcaagcggtactggctgaaagacggcaacaacgtacccaaacggcgcagcaactgacacagttagctacggacattgccacggcgcaagcacaactccaggagttgacggcggatggtcagtacgctacgctacgtcagcaacaagcggatctacaaacggagatcacagtcatggcacgtcaatggctaacgcggcagttgggtgcgaactggatcgatacggcgctgcaggcattgacacaacagcaattaccaactgttttggccgcagcaaccacgattttcgcgcaattaacggcacagcggtataataagattgacttagacggtgatgaaatggttgtgaagacggcaacaactcagttcatggtcgcggaactttcaacggcgactaaggaacagttgtacttggctttacggctagcattgatcaatcatttgggccaagtagctcagctaccactaatgattgatgatggcttggtgaattttgatgagcagcgtaagcaagctgcttggcaagtcttagcagcagttgctcaacatcatcaagtgctctactttacgaatgagacagcggcactgacccaactgaagacagcgactgtacagcagttaacctaggggggataacatggcaaagaagttatttgattatcaattagatgaaaccgtggatggctattttttgttgaaagattcggaagttcgcatcgccaagaacggcaagaagtttttagccattaattttcaggatacttccggcgagatttccgggaagttttgggacgcaagcgatacagatgtcgaaaactttcaggcaggtcgggtcgttcatctgaaaggtaaacgcgaaaactatcagggtaatccgcaaatcaaaattcaacaaatgcggctcactcatagtggcgaaccgcaagaagtgcaacaatttgtggaacacgcaccactaaagaccgacacgatggcggacgaaatcaatcagtttgtctttgaaattactgaacctaattggaatcgaattgttcgccacatgttaacgacatttcatgactggttctttagctatcccgcggcgaagaaaaatcatcacgcgttcgccggtggcttggcctatcacacgttatcaattttgcgcttagccaaggcagttgccgatcagtatccccacgttaaccgagccctactatacgccggtgcgattttgcacgacatgggtaagacgattgaaatgtcggggccggtctcgacgacttatacgttggcagggaacttggtcggtcacattgtcctgatcgatgaacaaatcgtggagacttgtcaacagttgaaaattgacgaacagtcggaatcggttttagtcttgcggcatacgattcttgcgcaccatggtttgttagaatatgggtcacccgttcggccccatattatggaagctgaaatcttacatgacttagacgagttggacgcgtcgattcaaatgatgcagacttcacttggacacgcagaaccgggcacgtatacggagcggatctttgccatggacggtcgtaacttttaccggccaactggtgatcaaacgaagggtgaattatcagacgaacaaaattaactaaatcgatacggtgtttgaaagaactgttgaaatcaatgattttaacagttctttttgtgacctttatttttgatgacgaattccattggggtgggtgagacgttgcaccattaattagcgtgggccgttattaaagataaaataaaaattttaattgcaattaatatcctgacatgataagttactacgagtgattagttgttatcgttgaccattgcatacgtgttgaattagggcacgttgagcagtattggcgtgcacgatgcgcgtaatctagcggccagactgattgattaaacgataatccggcaactgtggcacgtgacgggaccgtcacagagacaaatgatttaaaattgcacgcattaggggagattatcgggatgaacgaacacgaagcatatgtaacgacattttattggctcgcggattgttggttggaaactagctatctgggacttgagaatgaatttgacgacgatgaaatcgatgacgccgtcaagtcactactaaatcggatgcaagccggggcaatttatgaggtaacggcggatgatccaatgtggcaagcatggaagcgggcagttagggccgtgcttacgcccaatgatcatgctgaacatgaagttgatgagaccgacggagccgacgaattagtgctgccagctggggtacgaccagaacgtcaattagaagaagttcaagcctatgcagcgatgaacgcgtttttgcaggcacaaaatcaggaatatctgcaagaaattggtaaacgggcggccactcaggtcagtggtgccggatggcaagtgtggcgtgcacatcgccagagcatgcatccggagtttgccgccccgctgacgttgactgctgaacaattaccagccgtgatgtgggcctttttcgataagtaccaggatactgaggactcttttgagatttttgaattggttaaccagcttgaacaatggcaaaaaagtgctgatcgagatttggacgcgcaatggtcacagcttgtggcgaaaagtcagattgatccggccgcaattacgctcatgcagggcttgtcgttagcgattgagttctttgatcagcttgagtgggacggtgatttgactgccaaggcaactttgcagaataaattgatgcaacgcacgctcgatgacacgctcaatgatgagacgacagccaactggacagatgcctggcaacactgggatttagcagatccgttgacaactgaacagtgggcccgccggtttgatccggcggacgactatgaagacgatgaagacgagagtgaagaagatggcgcggctcggccagcttggcaacttggtgcgagttatagtaccgttttgattgcaatgcgcttagtcgcttacggtgtgctacggcctgagagtgtacctggtatggcaactgtgaagatggcgaaccgtgcactggcagctaccgtcagtattggtatcgtgttagttgcttggctggtcacagctattctgattacaattgtaatttggggatggcggtggctgcgtaagctgattttttagtgcagctgggtagtcgactaaatgacgatatggaaacgatggtagcaaaaccggtaatcatcggtgtcagactaccatcagtattagtcgcgaagattaaaactaagttttctgctgatctattttgcttgattggctagggttgtgtccaatattgtttttgtaatttgatctgactactttaaaaagctggcaaatgataattgctaattttttaaatgacgaatttacaattgaagtgcaacaagtaagaaaaaaataaaaaagaactcatagcctgagtcctataaaatgaagtcaccacaacaatcatctaaaggagatcctaggctatgagtccgtacaaccatcttaccttaaaagaccgagaatgcatactgttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcgtggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctggtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcataatagaccactgacaaaatatccatctgcttggccgtcttaacggcttaaaacagatgggtattttgttgtgttatgaaattgttgatgattgtgccaaatcggcttctaactgggttaagaagattgtcaccaagtctttttctacctggttcagtgaatgctcggctggaaaggcaatgaaataattcagggacattaacgcttggggcaaaggtaagatgttatagcgttctggatcaggttgggtgtgcacactgtctggtaaaaaggtaacacccagtccagcagtggctagcttggtgatggtggcggtattcgtgctctcaattacgatattcggtgtcacgttgtgcttttgtaataagtagtcaacttggcgtcgaatcgatgatccgtggggagacaagactagaggcgcttgtagcaggtcgttaaggggtaacgctcccggattaatgaaggtctgatggggttggtaccatttgacggtgttcgggataatcgcgtagtacccgtcccgaccgcggtcataactttcaagccccggcgcgatggtttccggattttgaccaattaagaagtccagctcaccgtggagcacgcgctgttcgttgcgactagcgatatcttcggttaattcgatcttagtggccgggtgggctttcaaaaaagcaggtaaaaataggggcaataagtaatagccgaggctagataagacgcccagccgaattacttgctggttggcatgcgtgtattgcctaatttgcttattaaagtaatccttctcgttttcgagcgccgtcaaatattgataataagtccgcccagccgtggtcagtcgcagtggcgtgacttcacgattgatgatggtgacgcccaattctttttcaacattgcggatgctttgggtgaggtaaggttgtgaaatgtagagatctttagccgcccgggtaaaattgccgtgcttgagcaacacatctaaaaaccgtcgcatttcgctggaatctgattttggcataaagcgccttcctctcgcattgtgattaggtgagtattcgtttgattgctgatttggtcatgttgagttagttgcatcgccataaggacgttcaaaacatgttcaataagttctgtcaacatcctggcgatagtggctaaatagcattatgaccaaccattttaacatgattaattttaacgcgaatcgtcgacatagtaaatttgttatcggggtatagataaataaatatttcacaagcagagcgctttcacttacactaatcagtattaagagtggccaatcattcaatagctactcgtcgaaaacgactgtttaaatcatcctgaaaggatctgaaattatgaaatttgttgggattgttgggacgaatgcaaccaaatcgaccaaccggcagttactgcaatatatgcaacggcattttcagcaacaagccacgattgaaatttgtgaaataaaagatttaccggcttttaatgaaccggaagaccgaacagcaccagtagcaattcaacagctcagtgataagatcaccgcagcagatggcgtgatctttgccacgccggagtatgatcattcaattccggccgtactaaaaagtgcaatcgaatggctgtcatataccacgcggccgttaattaataaaccagttatgattgttggggcctcgaacggctcactgggaacctcacgcgctcaagcgcacttacgccagattttagaggcgccggaattaaaagcactggtgatgccaaatattgaatacttactaggccgttcactacaagcttttgatgatcggggcgacctgacttatccggataaagttcaggaattagacaatgcgtttggcgaattcattgattttgtggatttaacgaataaaatcatgccgtcgagtcagtttttcgaaaagagtaagcagttctcgtggcggcaagtgactggggaggaataaacatgaaatttgttggaattgttggaacgaatgctcagcattcgtacaatcggatgttgctggaatttatgcaacgacattttgcgacacaagccgaaatcgaaattttagaattgactgatgtcccgatgtttgatgaatcgaatgatcaaactgacagtaccatcattcaaaactttgccactaaaattgcggcggctgacggggttatcattgcctcaccggaacacaatcattccgtaccttccgcgttgaaaagcattattgaatggttatcattcaaaattcacccattagatggtcaagcagtaatgattgttggggcttcatacagtgtccaaggatcgtcacgcgcgcaactacacctgcgccagattttagacgctcccggtgttaacgccagtgtcatgcccggttcagaattcttattaggccgtgcccaaacggcttttgacgatcaaggtaatttaaaggtgcaagggacggttgattttctggacagttgttttgcaaagtttcagaagtttgcgaccatcgtcgccgagatgcaggcaccagaagcgcttagctttgccccgggtacttatcaggtgacggccactggacataatggcgaattgccaatgcgagtgaccctctccgctgaccggattgaaaatattgaaattgataccagtagtgaaacgcaggggattgccgatgtggcttttgaacgcattcccaaggagattattgcgggtcaaacgctcgctgttgatgcgatttccggggcttcaattaccagtcatggtgttatcgatggagtcgctcgtgcggtcaaagaagctggtgccaatcctgatgatttgaagaaacggcgtgcgactaagcaggtcgctcaacctgctgtcaaagaagtgacgactgatgtcgtagtggttggtgctggtggggctggtttgacggcagcggccaaagtgttacaggctggtcatcaagccgttgtcctagaaaaattcccagctgtcggtggtaataccgttcgcgctggggggcccatgaatgcggctgatccggattggcaacgacagtttgcagctttgccaggtgaaaagcaaacgttgaaggatctgagtgagcgtgatgaaagtacaattgcacctgaatatcgagctgatttccgtaaattgaaacagcagattgacgcatacctgactgccaataccaatcaaaagggcaccttatttgattcaaccttgttacatcggattcaaacttatttaggtggtcaacggactgatttgaacggtcaagagattcacggtcagtatgatttggtaaaagaattgacggataacgccctggattcagtcaagtggttacaatcgattggtgtgaaatttgatgaaagccaagtgacaatgccagttggagccatctggcggcgcgggcataagccaatgggcgatctagggtttgcttacatcaagactttacgggcctttgttgaacaacaggatggtacgattatgacggaaacgccggtaaaagaattactggtgacagatgggcaagttcatggcgtcattgcgactaatgcggctcatgagaaagttattgtccatgctgatgcggtaattttagcttctggtggtttcgcagcgaatactaaaatgttacaaaagtacaatacgtactggacggccatcgacgatgatgtcaagacgactaattcacccgcaatgactggtgatggaattcggctaggaactagtgttggtgcagcattagttgggatgggcttctcacaaatgatgccggtatctgatccggagaccggcgaattattcagtgggctccaagtgccaccggctaactttgtgatggtaaaccagcaaggaaaacggttcgtcaatgagtacggcagtcgtgatgagttaactcaggcggccattgataatgggagtctcttctatctaattgccgatgatgaaattaaaaagacggcttacaacacgacacaagctaaaattgaccagcaggtggcgaatgggaccttgttccgtgctgatactttgacagatttagcgcaccaaattggcatggacccggcagccctgaccaagacgattgcggattacaatcgttacgttgatgccggcgaggatcctgaatttcataagacggcctttgatttgaaagttgccgtggcaccattttacgcaacgccgcgtaaaccagcaacccaccacacgatgggtggcttgaagattgatccggatgctcacgttttaaatacggacggtcagattatcgacgggctatacgcagcgggagaagtagccggcggaattcacgcgggtaaccggctaggtggtaactcgcttagtgatatctttacgttcggtcgaatcgcggctgctcatgccgttgctgagcacgttgatccggtgacggcctaaggcaattagtaagtcgctacgttggttgagtcgtgttagtgtataatcgaccgtagagagaagcagatcgacaagggagattatcacatgcaaaaaccaatgccagtcgcggtgacgaacattgcggacaatattacgcatcaaccagcttatatgacgattgttttaaatgatcacaagtattcgaccgcgcgcaaaaagacgccgtttatcttggaagcgttgaatgagggcgcggctgctcatggacgtttgacgattacgcctagtcggctgagtttggccgatgagcgcggcacagtctttcaaactttggcgccaatacctacagtcattacggacgtcgaactgggattgtatcgctcaatcgtgcggcaacttggtaatggcgtacgaatgaaggctcgttacacattggcggtgacgttgaccagtgataccgctacttatcagatgttaaatactgatctgtcagtgttgaaaccgctgttggcttggatcaccgacttccatcttcacttaaccgattcgttacaattggcaacccgtaacatcgactggcccaacttgacggatgatcaatttgaagcattgacaaagggcaccccgtactttgcctggcaacagacgatcggggcccactggtaagtaaagttaagaacgacaaaatatgaagccagactttcgataatagtcgaaagcctggcttcgttttttattataaaatttcaccgacaaagtcgccttggggcaattgtcggaagtcgtaagtttcaaaatcactcacttgtttggtataccagtgtaagctttcggtaatcatcaggttgacggcctcatctttttcctgcaaggcgatgatgggcaagtcgcgcatggtagccacacctagctcgtaggcggtaccagaatctaagtttttggcttcaaagtctaagacagtcacgatgacttgcgcggctgcgatttgggccatgtcacggtggaaaatttcggtcgtccaagttttggtgaactgttcggcttgagcgtcctggtgtagacgtggtgaataaaaatccgtgaccgttggatttttagtgagggcttcctcaagctgtgtgacccgtgtcacttgttcaggactgaaaaacggactagcaagataaatttgtgccatgaagatactccttaaagttaatttagtaaaaagactaatggcttaattttagagattttgggggtcaacgtcaatttatttttaactactagattgcgttgtgatgggaatgctgataacacttgataagtggctagtatagacgtctcaatattaagcggaaatatggtcgaatacagttagttgacgttatctggcgaagttctccgtatacctaatgcagattggacttatatctatttgtttgtaaatttatcaatggcaacttattaataacggcgataaaaaagatgggcttaatataacttgttaatagaacgattgaagatttcaattaacgttctagttgtcaatgtttggttgtgtttaaaaaagaatggaggcaattttatgcgagttaaattgttttcagtcctgctaggtctgttaacagttttagcaacagtcttagtgttagggcggaccgtgaaagcggcggtgattccagcgactggcctgactgggggagcggctgtaattacggatcgtgatggtaaggtggtcacagagacaagtaccttgagtaaatggagtgattatactgttaagtatgattggtccgtacgtgacggtcagccaattgcagcaggtgatacggcgaccgttgatttgcccgccggtacagtggcgcctgttgatttgagtttcccattgaagaatgataatggccgggttgttggtatttttacgattaaggcaggtgaaacgtctggagagattacttttaatgatacattggcacaaacggggacgaaccgtgctggaacactacaattttatgttaagggaaccgccgattctgacgttcattttgattggaaactcaataaaattggttggattgggagttacgatgatcatggattgccggcaaccttaacgtggaacattgccttcaatccaactggtcaaaatattggaacggttgtcgtcaatgatacattgggccccaaccaaagttatttgccgggttcggtagttgctcagactggatcatataataatgctgggaacttcgtacaatcaggtacaatcgttccacaagttgtcgttaatggtaatcaactaacctttactttcagcaacgtcacaactgcagttaatatggtttataatagtaaactgacgaaagttaatgaaggaagtaatgattggactaactcggcatccatgaacggaaccaccgtcagtggcaatgtcagttatggtggcaatgggaccggacatggtgataatcagctcggcagtgtgacgttgaccaaacgggattcaacgactaaggcggttttacgtggtgccgaataccagttacgggatagtaccggggaggtcattgaatcggggctgactactaatgagaatggtgacataaatatcactgatttaattcctgggcagtatcaattcgtggagactaaagcacccgtgggctatacgctgaattcaacacctattaattttaagattgatgccgatacggtcgcaacgccggttgaagtgacgcaatttgatgaaacagcggtggttaccggttcagttgttttaacgaaggtggctgctaacagtggtcaaaccttagctggcgcaatttataatctaaaagatggcgccggacaaaccattcggcatggcttaaagactgatacgctggggcaaattcgggtagatgaactagttcctggtcgttatcaatttattgagactaaagcgccagcaggttatgctttgaatcagacaccgttagactttaccattgttgaaggtcagacggcggcagtgacagtgaaggctaccgatcaactggtgcaaccgataaagccagaacagcctggtgcaacaaagccagttaagcctagtccgacaaagccgaaacagcctggtaccaccaaaccggcggaacctagcacgtcagagccgaaacagcctagttcgacaaaaccagcagaatctggtacgaccataccagaacaatcaagtacgaatactagtcaaataacggggctcaataacggcactactgactcaaacgtaaccgtacctaatggtcaagatagcgtgggttcaactggaaatggctcactagcggtggctgcagatcaatctggtcaagtttcgaaggcagtaacgttaccacaaacgagcgagaatcaccagagcttgctcatcgcaatacttggacttgccttattgttgttgatgcttgtatggttaccagctaaataagttattgtttgactgaaattagaatgcaatggatttagagttatataatgggctttcagaaattatgaaggcccatttttgtgagcttaaatggattgttgtggttaataataagtccgtcacttaatcttaaataaaccggttttgaagattcggttggaattctgaatggttcgtaacacaaggttatttccacattttctttgtaccggttcgtaataatgggtggtactagcacgggggttaagttcggataatttgttaatggttggtaccgaaatcgttgctttgtttgaattgcgaggaagatattggtactatcaatttgaactattgagctgtgtgaccactgacagttgcctaggtcaatggttggatgattgagataaataattacagtaatagtcgtaagcttgcctttgaggattgtgggtgtcaagcattaatgattataaaattagtcgtggatagttgtgggggcagatattctgcgttattaatgataccggaatgtttttcgttaagtgtctaatttgggccacaatcgcatggcgctaatgataccgaaagttgcaattataattgttatttcgtaaaactatttgagtcatattgggggaattggcatgcaaaatccacggttaaccattattgtgccttgctacaatgaagaagcggtgttacctaagtctgcacacatcttggatggtatcttgacggatctgatccaacacaaacaggtcaatgcggcaagtaagttattatttgttgacgatggtagtcaagataagacttggaaactgattaagtcgttggaaaaacagtactcaaccgtgacgggtcttaagtttagtcgtaattttggtcatcaaaacgcgttgatggctgggatgcaggtcgccagtccgactgctgaaatagtcattacgattgatgctgatttgcaagatgacccacaggtgatcccagaaatggtggcacgctatcgtgctggtagtgatattgtattaggtgtccgcaatgatcgaagtagtgattcacttttcaaacgatggaccgcggacggcttttatcggctaatgaagcgtattggtgtgcaattagtacctaatcacgccgattttcgattattaagtcaacgggcagttcaggcactgttaacctatgaggaaaccaatttattcttgcgtggaatcgtaccacgactaggttttccaacaactaaactttattatcatcgccaaccacgttttgcgggtgtttcaaagtatccattacgtaagatggtggcttttgcttttgatgggatcacatcattttcaatcgcaccgattaaagtaattttattgttcggtatggtgattagtggcggtagtttgatgatgatgctatatgcgttaatacaaggattactagggaccgcaacgagtggctggtcctcactcatgacaagtctatggtttttaggtgggatgcaattgattggtattagtattgttggcgagtatgtaggaaaaatttttgcggaagtcaagcaccggccccgctatattattgaaacggatgattatacggcaactcaacagccagctattgtgaattcgcaacgggtgcacggatgaaggccgtggttaagagcgtcaattggctggcggccgcggtattggtcgtcgcagttggcatggcgtggttgcaaccgattcacttcttcggcaacccggactgggcgtcaccggtcgttcaattagccatggttcttggattattggtcatgacgatggctggccggcaggtgctcaaacagttatcatctcgtcagtatcgttggctgttgattgggctggtcggcttaatcgccatcgtgcaaatattgattgccactagttttgttgacgtggcgcgggccgacccgtttttcgttcggcagcaggcactgttattagcgcggggcagccatcattggcaacattattttatgatttatcccaataatgtgaattttacgttattagttgcgaatctgctcaagccattattgaaactgacgcagacgccctgggtattattaaatgtcatccgatttatctggatcgataccggactaatcagtgggttatatttactaaaccgttggcgttactggcaaccgggggcggtctcatttagtttgttgtggctcgtcagtgttcccgtggccgcatttggactatttgcatatacggacgccctcgttttgccactacttccagacagcttggccttgctcacactcggactaagcttaaccggctggcgtcgttggggcgttttgattggtgatgggttattggtggccgtgggcgtggtgatgaagactaatctcattgtgctctggctcactctcgtattgatggggatcatcttgtggtggcaacgacaattcagtggtcggcaaatgttaggctggctcgttagtttagtgatgacactcggggtgatgtttgcggtgatgcgaactgcccaacagcaagcgggttatacgcgccaagctgatgccgccttaccggcaaccagctggattgcgatgagcttgaacccccaaagctcgggtgagtaccgacatggcgattttgcgcgcgttaatcagatgccaactgcggcggccaagcgccaacagacccagcaaatgattcagcagcggttacatcagatgggcgttacggggaccctcgtacatttactcaaaaagatgcgggtcttctgggcgactggcgattttgatagctttaagttgaccacccagtggattcgtgcgccccgctggtatttgaatcatcaacgccagcttcaattttggctggttctaatgacgcaaacgatttacctgacgatgctggtgcaagcaatcgtgactttgatgaagcggcacgagtgggtcgtgacgttcgttgccctggtaattctcggtttaacggcttttcatgtcggactttgggaagtagaagggcgctatgcgttgccactattaccgggattgatgctcctcagtattgtgggtggtcgtgagttgccggtgtggcaccttaaccgagtaatgcggcgccaattgacgtggttggtcgtcgtattggcggcaatcagtgtggtcagtttgtggcagacgagtcaggcgacgcggattactgatgtgatacgtggcactcagggaaatgggcgttatgttgtgtccacggttcaaaaaattagaccgggtcacgctgttactacgccgttagccgttagtggtaagagtaatgttttacggctgaagccagttgcgacgcatgggcgcgtaacaattaccttgactaagggggcgcatattgtcaaacggtggcggggctcggccaatgagctgaccactttgaattatccgttgacagcggcgggcaacctgcgattagcgattaaaaacactggtcagacgcccgtccggtatggtgtgatggcggccaactacagtccgttaacaggcagagtgacggccaagcggcacgcgtacttacaagtcgtgataaaacagcagtttattaagccgcacgcgttaacgacgggtgccgccagtctagcagttgtcggctgtgtggcgctggcgaccattttgtcgttaggtcggttacggccagaaactgaataataaaacttgaatcgaaagtcttaataactggtgttgccagtgttgggacttttatttgtggttaaacgaaatataatagccgttaatttgggtgacttatcaaggtgaggtgaattcaaatggttcaaattattgcgcatactttagtgactgtcgggcacgacgttttaattttaaaacgcaatcagtttgagcatgggcggccgaatattgatgccagctattgggatctgcccggtgggagtgcattagctaatgaatgaccgcaagtagcggccaaacgcgagtgttgggaagagacaggcttgaaagttcaaactgagcgcgttatttgggaagatgccacctttgacaaggctaaaaatcaggtgtacacgcgtttagtgtatagcacacaggcattcgttactagaccagcaatcaacttagaacttactgaacatatggcctttctttggatgaaacctgaattaattttgactaatataagaattgtgtcctatctaaaaccgatattaacgcgactggtttagcagttacggcgaccattaaaacaacaatcggactgcctagcagaatagcttggcagtccgattgttttgattgacacgattctaatggtggcgatatcgttgacgccaaagaatgaagctaagtccacttatgattgaaatcagtagtccgcccagcaatcccgggacgtggtaagttagctgaatctgattcttaccgggctgaatcggtagggctaacatcccaccaatgaccgttttaggagtaactttgacgccgttgaccgtggcgcgccaccccttgtcggctggaatagcaacgtagagccacttttgcttggagcgattggtgacttgaccactgaccacggtatgaatgcccgagacgtggtaagtcggtgtaaagcgcgtggatagcagttgctgtttgacttggttgaaccgggcttgatccaggctggcgatgtggacatgggtgccaagcgttggttgggtacgtttgaccgttaacatgacgacagcgcctttgtcaaaataacctagcgatcggagcactaactcaccgttggcattgaacttagtcgggactaagtgaccgttgacccgcatcgtggtgtactttgtttgacgagtcgtgtcgttataatacagcgtcccggtgcgtgtcatccttaatttaaccgtatgcaaatacggatagcgtttggcctgtgaatcttggatgacgtgatctgagagcgtcgtggcgttgccaaaataggcgcgtttcgatggccgcaaactttgtaagaggcgttcttgattgataatggcactattctgacgaagctttaactgtctaaatgctgttggcacggcaaaccctaacccgttttgactacggagccgcgttgtcgcttgacccacggcgtttaattgcacagcgtattttacatctaagagtaaatcagtgaccggatttaggccttctgaactgacacgccgggcgtttttagaaaatagcccaagtgacttcaacatgagacgtgtttggttcgcaaaagttgaactgtagtaggtaatatcgtgaaagttaaataacatcgggtcgttgtaattacgatacttgctatcataattgtaggcctgattgattagcgtattttgattttcgacgcgatataattgaccatcaggatcgttgacggcttgcatttggcggtattcggttcgataggcagttacaaatttagcctgattccctagtggtgacttcgccatcatgagggtactgttagtccctaattctaaggcgacgatacttgccaagctgagcgtttgccaccgtttagccgttgcgaataaggcaattgcggttaagatgacagcgactaagctcagtgccagcgttgaagttgttaagtggtgcttagcagttcgttgggcgaaccagcctaatatcagcgcactgaccatgagtgtcggtaacaaccattgccagcgcaaggcgatccgccgggggcctgctaaccaggcttcaaaagcgatcatgatcaagacaaagctaaagaaaaaggcattgcggtatggaaaaccagctggtgtttgaaacatgtgccaaatcgtatctaaggtacgaatgtccatactcaagaagagtgcaagtaatagtccgaagccatgccatttgtgagcgttagtcaagttgggctgcacccagaaacttagggccagcaagacgaccagactactgctgaagacggtcggtgcgtgtacgagccgagtcgtaaaattggcggcacctaagccaaattgactcaaaacagctaaaccgaattgtgggaccggtaagtagctcgataatttgaccgcagatttagccgtggtcagcatacctaaaccagtggggatcaggacaaacatcgtgcttaacccactgagtagcatggtgaccacgacgcgccgaattaacgaaaattgatgacgaacagtttgccaaagactgtcctgagggcgtttgtgttcaaatagttgataaataaaatagtaaatcacaaataggcaagtcatatagcctaagtagtaattggtgacgatactgacccataaccagccgaaaaagcgcccgggatgaccagttgcaattaagtggtcgagtccttgaatgaccagtggtaaccaaattaatgcatccaaccacatgatcgtaaaatagttgagggcaacgaagccagagaggctgaaagcaacaccaaaaatggcagtcgaccaccgctttgtgtgaaaatgcgtttgtaaaaaagccgtcatagtgaccgcaatcaagctgatttttaacatgatgagtagactaagtccggttggcaaattggccgccggaaacaacaacatcaaaatgttaaatgggcttaatagatagtaagcaatcgtgggtagtgcgttaccgcctaatgactgtgaaaatgaatataattgaaaactatgcgttaaaatggcatgccgatacgcggtgaaaaatgataagtattggccacccatatcactaattaataagttatggttaccgaagggcgtgatcccccaaattgcgaagacaatccccatgatagcaagggacagtaatccagctgtcactgccacttgccagcgccttgtttgataattagaccacattttattcaactccgatattatgaatgatttcattgtaccgtactgaaacttgaaaactagttaagaaaagcgaacaattttctgaaaaaagttaagaattagtgttagtcattatcatttttataaagtttgctagcagtttaacacagcagttcacgaggttaaactaaaaggggtgattgacaattgattaagaaagtgtttttataaaaggtgaaaactgaatacgatttcttcggggcagggtgcaattcccgaccgacggtaacaacgtaagttgaagtccgtgacccgcgtgagcggtggacccagtgcaagtctgggaccgacagtatagtctggatgggagaagaaaattattgcttgaattttactaggcagtagtggctattggcgaccttaagtgggtttatttagctggatcctactggtgaaatctatttggcgaacacttcacacccgattatcgatgatttgataattgggtgtttttttattttgttggaggtgaaccaatgttaactgattttatgcaaatggctatcgatcaagccaaattggcgggggtggcgacgtaccaaaatccccaggtcggtgcggtattagtcaaagacggccacgtgttagctcaaggttatcatcattattttggcggtgaccatgctgaggtggatgtgttgcagcaggccacaccagaacaggcgcgtggggccacgttatttgtcacactagaaccttgttcacactatgggaagacgccaccgtgtagtgcgcgaatcgtcgcggctggaattcggcaagtcgtgattggtcaattagatccccatccaatcgtgggtggtaagggacgtcagtatcttttgaaccacggagttgatgtggtgacgggctgtttaacggacaaagttcgcgcgttgaacccccactacaatcatttttatgtgcagcaacgaccatggatcaccctaaaaacggcgataacgcttgatggcaaaattaatactgaaacgccgactcggacgctggtttccaatcatgctagttatatcgatagtcagtgcttacggtcacagtttcaagcgattctgattggtgaacggacgctaacgattgatgatccacaattaaccgtccgactgacggcaatggtgcagccaccggttcgattggtggtgttgaatacgagtaccgtggcgttaaaccaccggcttgttcaggacggtcaggcaccaacctggttactttgtcgtcaggctgcggctagtgacgaccaacttcgaaacagtcccaatgtacacgtcctgattggcaactggacacccgctgcaatcggccaactatgtgtcgaacaaggctggcagtcactcttagttgaaggtggggctcatctgcaagctgaatttgttgcggctgaattgattgacgaatgggtcagctacatcgcaccaatgatgattggtgggacgggtttgccagccgtcaccggggccgctgcgatgacaccgttgacatttgaacaaccaacggtaacttgtttagggacgaatatccggctacgggccgttcgaaaggaagttaagtaaatgttttctggaattattcaaaccaagggccgcgtcagccaagtgcaccaacaagggttggaaatgacccttacgattaccgcaccgtcgctgatgacaccgagtcttaagattggtgacagtatagcggtgaacggcatttgtttaacggtaacgatccgacaagcggatgctttcagtgtagtggtgatgcctgaaacggtgcgtcgaacgaacttaaagatccttgtggtcggttcattggtgaacctagaacgtgcgttacaagtgaacgcgcacttagatgggcacattgttcaggggcacatcgattactgtgggcaagtgctacagcgacaatctgatgcgcacgcgctgcgtctgttgatcagtttaccgtcagaatatcgcgcactagtagtcactaaaggttcggtggcagttgatggggttagtttgacggtcgtagcggtcacggagacgacgtttgaagtcgatttaattccgcattcacaagcggtgacgaccttgtctgagttacaagttggaacgctggtgaatgtagaaacggatattctgggcaagtacttggcccggcaattagctttagaggggagtcattaagatggatacaatgaaaaaggtagcagcggccttggccgcattaaaacggggcgaattgattattgttgcggatgatgagacgcgcgaagcggaaggagacatggttggcctagccgctaaagcaaccactgcgacagtgaatcggatgattacatcagcgcggggactactctgtgttccgatggcgccaagtatcgccacgcgactacatttgacaccgatgactagtgaacacgatgcgtttggaacggcatttacagtctcaacggatcaccatacgacgtccacgggaatctcggcagctgatcgggcgaccacgattcaagcgttagccaatcccaatagtcaggccgctgatttctatcatcccgggcacgtttttccattgattgcgcggactggtggattgttagcgcggcgtggtcatactgaagcggccgtcacgttagcacaattagcaggtgtgacccccgcggcctatatttgtgaagttatcaagaaaaatggcttaatggcgcggcgccgtgatctcaaagctttggcagagggcttacaattaccgctaatcaccattgaagatattaccacctacgtgattcaaacgggtgccgcccagctaacaacgaccccgagtgtcaacttaccgaccaaggatggtcagttcacgatgactggtttcgaagtccccggtcatacggcgttgccagtggcactgcaagctggtgatatcagtggcgatgaaccagtgttagtgcggttacactctgaatgttttacgggcgatgttttaggatcgcggcggtgtgactgtggtgatcaattacacgctgcactccaaaaaatcagtcaagctcagcgcggtgttttcgtctatttacggcaagagggtcgcggtattggcttggctaacaaactagcagcttacgcactccaagaacacggggttgatacgtatgatgcgaacgtgcagttgggctttcaaccggatgagcgccggtatgatattgcggcattagtgctacgccaaatggggattacacgggttcgtttgctgactaataatcctgacaaggttgagcagttacgtgcagcggggattgatgttgttgaacgggtccccttagaaataccagccaatcagtacgatcaagcttacttaaaaacaaaacgtgatcgatttcatcatcaactcacactaacggagggacacgaatgacaacttttaacggcaaaattaatggcaacgggcttaagattgggattgccgtggcgcgtttcaatgcgtttgtaacgcagcagcttttaactggggcacaagaaagtttggtacagcatggggtcaatgaaaccgatattgacgtggcctgggtaccgggagcttttgagattccactgacggttcaaaaaatgattacaaccaagcgctatgatggcgtgattgcacttggggcagtcattcggggtgcaaccgcgcactttgactatgtttgtcgtggcgtgacgacggggattgcgaccgtcagtttggtaaccgatacgcccataatgttcggcgttttaaccacggataccattgaacaagctatggatcgcgctggctttaagagtggcaataagggtgctgactgtgcggtcagtttgttagaaacgttggacgtgcagcgggcaatattaaaagctgacttggcctaaatgacgtaaattaagggtatgcataatatttcaaataccatcaatttgtaacttgggccattgttgatgccactgcttctgtgccattcgctgctgatagattgccatgtgcttggcatcctggcgatagtaggggattggggaacagcgaaagtttatcaaatcgtctacaccgtatggggcgattagcttgatttgattttcgtctaaaaaggcgccaatacaagttggaacttcgacaaagtgaccaattgcatcggtaacggaagtgaattcgggatccttatcaaaattataatgtgccatatagacctcattttttatttgccattggtattgtggggctttatcagtaagttgctgatagatttttaaatcatcgctggctggtcgctcagggtcaaaaaagacgacgtcaatatcactgttgaacatcactggctgcccgctgagtacttgccaaacagtattacggatgctaccagccgccaatgcgccttgttttaaatgacagtcttgaattaattgaagaatcgtcattaaagcaggagttgttttaataatatgaataactcgttgttcgttggtcattgaaaacacctcaatttaatgttggttaaaaatagtctaacatagtaatgatatcgtgcaattcaaataaaggatttgcttttgctgatttcataaaaaactaagaccgcttaccactactaactgatagtggtaagcggtcttagtttttggttgtgagtttaagtaataattgcctagtcttccgtaacctcaatcttaccaactgcaattggtagggttacgtgagcatcatacatgcccacttcaccagcgactgatgcaggtagggctaagtcttgtgggacgccgtgaatataaatgacccgcttgtatagttctaagtcatcggtaccgaagacttctttgaacttagcctgtaggtcgcctaagggcacatcgatttcataagcgaagtggccctgcgcgtcggcaactgggtaattatcatttggtacgtccatatgatggggcgcattatcaaatgggaccatcgtcgtcccagaaacaggttcagtttcaggcaagtctacaaagccgtcgtgattgacatcttgggccatagtagcaatctgtgccgctttgccatctggaaagccgtggaaatgttcccagtgttgcgtgttggccggggtatcgaacatttcaatggtgacgtgtaattggttaccagtttcagtgaaagtcgctgtgccgtgtggggcagtaccgattccttcggcgttcagcgggacgatgttagcaacgtattttttagtcatgaataattcctccagttcttcattatatggtcagtatatgctagtctaatcatataaaaattgacatagatcaagaaaaggagaaattatgcattcaaaaatggattgtgtgagtcgttcaccattattttcaccgctagcgccagcggtgaaagccaaattaatcacggtgacccatcaccggaaattttatcaaaaagggcagttgattcgtcagccactcgaccatcaggaaggcatgctcattttagatgagggaacggctaaaatttatgccttagctgctaatggtaaggagaaaattattgagttgttgcgtagtggtgatgtcgtcggacaacactggctatttgcaccacatgagaatcagggatttattcaagccacgagtgatgcgtgggtctgttccattcaatatgatgattttcagcgattattaggtgaatcagccagtttatcattagcaatgatcaataattttgggaaccaattgattgaagctgagaagaatcaattgcgacgagatttgctggatgctaaagcgcgtttgatggcgtatttgcgcgattgtgccgttgaatccggacaaatcgaatttgaattgccgttgaagaagaaggaattggcgaatattttggggattactcccgaaaccctgagtcgtcagtttaaacaattggcggctgaagggcagattatcgtcaataagcgccagattacaatttgttagacgggtaaaggggggcgtcgcctggttttggctagttaagggtgacgctggttcaatattaaaaataaagtctgatttccaacgcagtatgggctaggaaatcagactttatttgacttgtgaggaagaggttctttaatgatgaaaatgccggttagcaacgccacttgctcgcaatgccggcaaaacgacttgatcaatgagattggtgagttgctgatcagtgttcatcggttggttgatgatgtcgcagtaccgtaattgttgaaacaatactaattgtgcggcttggttaggccaaatctgaagttcaccgtggttttgtgcattcgtcagaagtggctcgatcaaggtcaagttggcatgatcaatttgagtcactaactgcgtgagatcgtgctggttctgcgcgttcaaggctgtggcaaacaatagccgaaaatatcggaagggccccgtactagtttgttggataaagcgttgcgctaacagaatgagatcggtacgaagactgccagtatctaatggcgtggtcgtaagtgcaatgggagtctttcgtatttgatgaataatagtatgaaagatgaggtcaaaggtcgaatcccagtagcgataaagaacactgcggctggtagcggccgcagtggctactcgtgaaaaagtgacctggtcgaggccgtattgactaagcagggtataggtggtgtcataaatcgcgttttccagtcggttgccacgtcgacgttgattgagttgggtcacaaaaagatctcctaattggttttagaaacagtttactgctttttgtgccttaataatagtgatttccgtagccaaacgattgttgtagttaaagacaacgtgtatcttaaatagcgttgttaacaataatttaagtaatcagaggcggaaaatatggcaaaaattattattgtcggggctgcacatggcggccgcgaaacggtcaatggcttattagcagctaatacggataatgagattcattggtacgagcacgggcaattcgcgacggctttggattgggctccggcggatgctgaaaaagagcggttggccttgtcccagcaggtgactctattcgaccaaacgacggtcacaaaaattaccccagcgacccacacgattactgctcgtaatcaacgggggcaattacagactgatcattacgatcgattggtattgagcgttggatcgttaccaatccagttaccgattcccggagccgaattatctggtgttcgatcgattcaaaaccgtgccagcatcaatgagttaaaattggccgctaagtcagcagcaattaaaaacgtggtcgtgattggaggcggctatattgggatgaattttgcagccttatttaaacaaaccggcaagcaagtaactgttattgatgtgaacgctcggccattcagtcacaatcttgattcagaatttacgcaaattttagctgcagcgagtgttgagaatgggctgcaattaaagatggaagagcgggtgacggccatattaggttcaacacacgtgacagcggtacaaacgaatcgtggtcagtatgctgccgacttagtccttgtcgcagtcggcaatcggccgaatactgcatggctacggggaactttgacgctagattctgagggattaattgagacggatgattattttcaaacaagtgttccagatatttacgcgattggcgatgcgactaaagttcggtttacgcccacgggtactaaagagcggatcactttaggcagcgcggccagtcatgccggtcggttattagcgcataacttgttaacggatcagcgaattgtgtttcccggcgttcaggcaacgtccgcgcttaatgcggcgggatattactttgctgctacgggcctaaacacgcaactagctgtccgtatgcaacaaccagtgttagcaacttacatcgcggttccccgattggtggcatccgcaccagctcgattgaatgcgaccgttcattttaagttgttttatgataaaactcatcggatactaggtgcacaaataatgtctacagcagaattaacggcggtcatcaataccgtttcgctcgcaatccagatgggagcaacgctcgagcaattagcctatggtgactttttctttcaaccgggattaagccagccggtggatgtactcagtacggctagtttacaggcgttacaaactttagccactaactaggttgattattgccaagcccattatacggacttggcaattttaagttgatgtgttgcttaagctcagtatatgacatggaaaactagtggttactgatgattagctcattaggaactcacaggaaaaaaccgtcgcgtcatcaataatgatgggcaatccagcgacggtcaaatttaagtgatgaaatcgacaattattgtggtggtctaatggtgctttgaagtcgcgcttccaattgctagagttggggccagtacttaaggtgtacggccgaggagcctcagtttggcatatttaatcgttagttcgtcacgttagccgttagcgtccaagttacggttgtgttataggtttggcccgcttgggcggtgttgccaggaacggtcaattgaacttgggtgggttgccagacgttggttgaaaggtttttccccacgttggccgttgctggggctgccaagacgggttgttcggcggttgtgagatcgaccgcgtagcttttgagctggcccgtagcgcgttcattataggtctgcccggcaggaatgtgtaacttcgcgccggtgagttgggcgcctagtactagtaaaaggactgttctgacgggcagtgacggtccaaccgtgagttgctaaccgattatccgaaacttggagccactgtttcgcgacaccgttgattgtctgggcggcgtaagttttaggctgcatacttgttgtgacactgccaaagttaaattggctgggcgcgtagtctaaacgaagttcgcccgtattaccggtcccagtgttttcgctcccactggtattggtcgtaccagggtgctcgggctcagttggtgctgtcgggccgattgccggtgcgacggtgtattgggtagcggcggcaaacgtggcatcatgataagttgtactggtgaccggattttctttccccacactatctttcacaaaaatctgaatgacgtcgttagcttttaatttagtggctggcatcgcaagggaccaactcccatcactggcagcggttgctgtgatggcattgccgttgctatcagctgcggaagtcccgttaaccgtgtaacgaagtgtgttaccagccgtcgtcgtggaaccgctggcaatcgttttttggtcggcaacgatttttccatctttaacggttaccggcgtcggtggcgtcttatcttggacggttatggtgacaggatctgaagtataggtggtcgttgcttgagctgtcatagtcgtgccggccgttggaaaatgatctaaggtgaaattaacgtaaccgctgctgtcagtcgtaccactttgcgttgcgccttgatcatctgttaacttgacggttgccgtgcccgttccagcgtaaatcggcgtttgtgtgccattcgattctgtataaccggtgataacgcgaacgcggaccttcttgtcggcattggtgacgagctgggcgttcaagtcactcgtatacggtgagctgaattgcacagtcggcagtgagagggtgttcgcaattcggcgcgcagccgagaaggtgagtagtcccggtaagacactaccgctgttggtaatcaggaccccgttctgttcgatggcggtgatcccttgataggtcacactggcgctcaacaggttcaataaggacaatgaccacatactcaggttactgttcgtgattttgaaacttttaatggtcgtctcgacgattgaacccgtttgaacgagaattgcaaagtccgtatttttaatgtcgtaggccttaggagaatctagcaagacgctcaaaccggacatgtagccaccaaaaatgggggctgagccactactagtgatatacaactcaccacccgtcacggtaaacgtactgttgttgccaagcggaatcaacggggtagcgtagtagagcgcattactactagttgtggctaagttctcaaacgtgaccttactgccaacgttggcggtaaacgtgtttgctgtttctgcccgatagacgttaccgtacatcttggcggttaggatagcgttggtacccaccgtgacggcatcatactggtcatagaaaataccccgagtcgcgtctgatgcgctacctagcaagttaacattagcagcgctaccaatagtgactttacggtctccagtcccaactgtactagttgccgtgaagttgaagaaagctttgttggcggcactgttattcgccttgcgaccgatgtaggtactgctggcggcaaaggtcattccaccagtaatcatgttttcagcgacggttgttgcggtgactgcgccactgacattgacttgattaccaggagcgttgacgaggcggtaaacgtcactggtagtgattaaatcggtcactgtaatcgtccaacgagctccaccagcattagccccaccatcggtcccactttgaatgattccggcggcgccaccactacttgttccactcgcaattgcgccacgaatactactgaagttttttactgtcattgtctgggccgtggttgtggaacccaatgtgaagttaccgatgccgagatcaaggctgtgattttgcccgtcgatggtcaggctggtggtacgagtgcctaattctgtagcacttgttgacgtgtgggtaatgttggcccccaatttaatcgtcgtgacggcggtattggtatacgctgattttaaatcatcgtaagttgagacggtcgtgatatcattagcggctttggtggcagtcgctttagtcgctttcggtgtccgttctacttccgaatcagcctgcgctgtgcgactagtagcagtgtcgttgtcagcagtcgggtccgatgtcgcggtggtactagacgactgttcggacgatttgcttgtggcattgttgtcatcacgtttcgtggtagccgcttgtgttgctgttgctgacgaatcgtcagtggtcgggtcttgactggccgaagaggtgctttcggcatcattgctgacctcacgtgctgattcagtgccggcttcttcaggaggtgagtcgactgcggagcccgcggccacggtgaaagttattggttcagcggtcatggtgtgggtcgtcggtttttcactactggcgacagctgaagcggtagtggtcgctaatgctggcccagtaatcagtgcttccgcggtcactttgtaggttttcgcttcactggcactcaataccaaatcgaacgtggtactggctgtcggatcagatggcgtcaaagttagtttccggttgtcagcatcaaaatccagctcagcgaggctcgctctgttggcttgccgggttttagtttggtcaacggtgagggcctcaggaatagcgaccatgacttggtgttcctgggaaccttgtacggccaactgaagtgtaaaaggttgcccaatcactaattccgtgggtggttcctcgaatttgattggtgtggccgtggtggtcgctgtcgcataaatggcaccgccgttgacaacgagtagactcattaagagaacgagtaacccgagccaagccgttattaatcttcgtggtcgttgcaaattgatcactcccttcggcgttgcatgagccacacgagccaaccggctaagacagctgtcaacagacctaaccagactaacagttggcgggcttcattcgtttgtggtagcactgattgatctggacgtattgccgcggatgatggtgtctgagtcgaagcctgttgattagcagtggcgatgatgttgggcaccgctagatattgatagggacgggggtgttggaagtttgtcaggtccgtcccggcttgccagtcggtcaatgtcacactagtgtcagttggggtagccgctagggcatcgggactccgacagccaccagcgagggctagtccaaggcttaatgatagtaaaactagccgcctgaatttagccataacgataacctccttgtttgagtaccaagttagaagataatctaaaattaactgcttatttaggttctgcgattgtgtcgtttcataattagataaacgattccggcggataagccagcaattacaatgacgattaggacgtaccaccagatactgatgggggcggccgggtcattcttggctttttgattattttgacgtgcttgttcagtcgtaatcttaaagtcccgggaccaatgccaagtttttttggcccatttggagtcgttagtcgttgcggtgacggataaggtataatcacccgcccgcatgacttgatcgtctaaaaaagtggggtaagtgaagttcgaattaggggccatgatcaagttgtcgctactgttctgatagagtaccttggaactgccttttctcgtgaccttagtggtcagttttaattgcgagaccactgctggttctgggttccgaatggtcgcgagcacgactttgtgatagttgcgtaatccgggagtgaccgtccccaaagtcaacttaggctgtgcaatttctttggccgtcagtttaaccgctaacgcataactatatttttggttaatattgacgcccttggatgcttttttcgcgccttgccccattttttcgaagtaccatgagcctaagattacaccggtatcgaatcctttgggaatgttgattgtggcgctgacgacccggttactcttggcggggaccgtgactttatcggaaccggctgccaaagtcgcaatttgatcaaaacgatattttaagctggcatcgtatcgtttggctgtttgggtgtaagcgatttggcctgaatcattcgtaaatgtcgtgagtagctgggtcttgaccgtaattgattggtcagtcgggttatagacccgcgcctgaattttacgagtggtgcccgccttggccttaaggtcgaaaaacggactgctagcatcgacttcttggccgggactgattttgttaacactatattgaacttcggcattggtagcggtggcctggacgcttggcgaggtccaactcatgaaaaccaagccaccaattacgccgaataagcacatcaattttttcatgattacctcctagttagtggtagcggcgactaacgtccaaactaagttgttcgtgtagttaccgacttgggctgtcagcttggggattgaaagggtcacggcacccgcgttccaagtgtttgtggaagtggctttaccaacacccgcccggttgggggcactgaaaacgacttggtcagcggtggtgacgcttacactgggggcaacaactaaattggaatcggctactgaggcgggctcgtttagcgaattacgcgcagttccttggggtaggtgaatcaccgcaccagtcagcacgtgattattactagcgttagttaacgtccggtcttgcttaacgttgacttgccagccgttggcagtggtgcgtttgtccgagacttgtagatattgattgtagttgccaattgcagtgtaagttttggctgcgttggacgtggtgacggtaccaaagtcgatagttttgggggccacatcgagggtcaatgttccggtattgttagttgccggattattcggatcggtggttgtcaacgggacgttgggactagtgggatcgactggggacgtggcactagtatcatcttgaaaagtcacggtaccattagtcgttgccccgatagccgtcaaactggttgccattaaccctaaaatcgctaaccccgtgctaagacaaaagcggttaaacatggcaatccctccttatggttagctaggggtagcagcggtcaaggtccatgtcaaagtgttgctgtaggcttctggtttggccgtgtttttgggaatcgtcaaagtgacatcacttggatcccaaactttaaccgaagtgcctttaccagcgccggtagtggccgttgtattaaaaacggtcacggcaccactcgtattggtaacatcggcagctgtagtcgtcaggttggtatcgaccgccgtagggtcagttgccagactattacgtgcaatcccggctggtacgtggatggtggtaccggtcaaaacatgcggtgaacttccactagtttcggttaaatcttgatcttgctcgacggttacggtccaaccctgttcatcggtcccacggttatcggtgacctgtaaatattgttgcccattagtggtcgtcgtggccttataagtgtgttcggcggcataagtttgaacggagccgaagtcgaaagttcgaggagccacgtctaatgttagagcaccagtattaccagtagctggattgtctggatcttctggaacttgtggattggccgggttagtgggatctactgggatagttggtccagtattttctgtcaattccaaattagtagttgtgttcgcagttgaatcggcggttgccatgacggcgggcattcctagtaagcttaacaacatggtcgcggtaagcactgtttttttcatgatggatcgctcctttttggttgtccgtgcctgcggtgatcaacaaatgtttggtaacgataatcaactcctggccagaagattgtcttgcgtttatcgttgctataaggctagcataatctattaggttgcggctatttttatgcatatatttaatgattagcaattagtcttagcttattatgttccgagggggttctgaatttattgtgatagcactgatatttgcgccaatgctggcgataggggataataaaatcatcaatttttattgatgactttgaataattagactgactagcgaagtgtgcgtgaaatgattaatcataattaacttgtcagctgattgatctgctaaatagagacgtatatttctagcgcaataataattcatgcttgacgcgctagacttagtacgacgcaaaaaaagccaccctgacatgttaaatgtcagggtggcttaattaatttaattagttagagcttgatgaagatgaggttgaaaggtatgacgataagatatccttcaaatcgttatccttgattgaaacgttcccacccttaagcactttagaaacaacgttttgtaagacagtggagtcgctcatatcattgtcccaaatttgtttcttcaaatcagcggtgtgatcagacatcttacccttaccagggttcttgatcatccggatgatttcataaccgttgctggtcttaacagcggaagtcgtgtattcaccgttcttcagcttgaaagcagccgttaagaatttagatgagtagctcgtgttagtgttatcaaaggctgaaaacttaccaccatcattcttagtcgttgtatcagttgaatacttcttggctaacttcgtaaagttggcttggctagaatccttcttcaaagcgtctaagactttgtcagcagttgctgatttggcaactaggatatgttgaaccgtgactttaggttcgtaagacttccattgcttcttcaaagctttatcagtaatcttgaccttgtctttaacggcttccttcaataataagttagaacgtaattgttccttgaaggtcttggtcgtcaaaccattttgcgataagacggttgagaaagaactaccatattgtgacttgtaagtattatattgcttcgtcacttgcttagtcgaaacttttgagccataatccttttcgagcaccttattcaggatcatttgttgcaagacttgcttacctgaagaggttcccttcatactactgtaatattggctttcggtaatcttaccaccggaagttgatgcaacggtcttgctaccacaaccagctaaggtgaaggttagtaagacaccagcaagggcaatgagccatttcttcattcctaaaacacatcctattcttgaaatcgttctgcgttagcagacttcaacgactactataccatatctattaaagcttctgcatgcatatggaaatctttacaaaattttcagagatttcacagcctcttcataaattctacctaatgcgtcagtgaatttaaacgaaatcagcttgttaagatagcaaacaaaagaatcgtgggcctaatgcgacctcacgattacttgctcagtcggttgtcttggttaaatggtctaaggtgtcttgtaagtgatccgcacgttttttcatgatggctacgtggggttcaatcttaaattgaaatttatccaattcagtctgaatgtcatcaaaaacttccgcagcgtgggccatttgaaaactgagattgctctgggcatcgctaaactcttcacgtgcgtcttgtaagttatcagcagcatctaaaacgtcttgcacgtaacttttgatgtctgtgtagagcgctttaggtgttttctgattgatcaacatgtaggtagcagcactgagacccagaccgatcaggctgttacgaataaactttgccatgggagacctcctaattagctaattcagttttaatggcgttctgtaagcgagtgtagtcggtttcgtcatattttttggcgttgtccttaaagatcatccgaaaatcatctttatcgctgtagcgggggatgaggtgaaaatgggagtggaagacggactgataagcgaccgcaccattattgttaacgatattcatgccaatgatattctcgtcagttgctttgatagcgcgggcgatttcaggaatccgcgcaaacacgatgctggcaagatcacgatcgtaaccgaaaatatcggcaacgtgcgtcttcggtacgactaaggtgtgaccaggagtaccttgcgagatgtcaagaaaggctttgaccatgtcgtcttcataaacggtatagctcggaatatcgcccttaattattttacaaaagatacaatcgtcatcgagttttggttcaaaagctgtcatgtgataaccttctttatttattagttgggttcattatacactatcgatgttgcggcaatcaaaactaggtagcttgattgacgacaaattactgaagtttcggtaaagtcggggatcaatgagccaaccaaatagagggtgtcgtgatggctatgctataataggagcacttataccaacacagaaagaggttaacgttatgacattagcggtacaacacttagttggtgggtattcgcaaatttccgtcttaaaagatattagttttcaagttgagcccggtgaattagtgggcttgatcggacttaacggggccggtaagtcaacgaccattaatcatattatcggtttgttgacgcccatgaaaggatcaattgcgctcaatggcgtgacattagcacaagatcctcaaagctataaaagccaaattgcgtacattccagaaacacctatcttatatgaagagttaacattaaaagaacatctagaaatgacgatgctggcgtatggtttagaccaagaacaggcttggcaacgggctcatgacttattgaaaactttccgattggctaacaagttggattggttccccgcgaacttctcaaagggaatgaaacagaaagtcatgattgtttgtgcgttcatcactaacgctaagttgttcattattgatgagcctttcttaggactggatcctttggcggtgcacgacttgttggcattgattgcgacagtcaaagcacagggagccgctgtccttatgtcgacgcacgttttggacacggctgaaaaagcttgtgataagtttgtattattgcatgctggtgaagtacagacacaggggacttttgctgaaatcaaagcgaattatccggatgcgggtgagtcgttaaacgatatttatctttcattgaccggggtgacccgtgatgaatgagttatttcaaacgcggttgcagcggcatctgcgtcggatgttgcgctacctaagattggtgttcaatgatcactttgtcattgcattaatgttttttgtcggcggactcgggctggcttattccaattggctcaagacgcttggccctcagcagacgtggatcgtctgggtgctcggtctcttattatgggcgggtctaagtgtcagtcatatcgcaacgttattagaaccggccgataccgttttcctgttaccacgtgaacgggatgtgcatgcgtacttcgtgaaagcgtggcgctacagttggtggttggcgcaagcagtccaagtgatttttgttggcttgaccgtgccgttgctcatgatcgttgatcagatgacgggctggtcgttgctggcgttactcatcacccagttggcgttaaaggatgcccagttaacgctgagcgtgacgcatctctatcaagtgaagccaagcatgaagcggtggttgcgccccctgaactgggccggcgcgttcgtcacgttggcagtgggactattagtgacgccgtggttgagtgccgcaatggccatcgcgattgcggtgggacaacgttatttgcaccaacgaatttggtcgaccacggtgattgcttggcgtgacgacatcaaagccgaagccaaccgtatgttagggatttatcgattctttaatttatttacggatgtaccaatggtgcaaggcagtgtcaaacgtcgtcggtacctggattggttactacggtggttacctaaggatcagcagcatgcgtttggctacctatatatacgtggcatgttgcgcggcacggaatttagcgggttagtggttcgtttgacagttattggtgcggtgctactgtactttagtgggcacggttggttagcgatggcgttggacgccttatttatttacttgattgggtttcaattgttgccgttttacaagcaatacgataatatagtttttacgcacatttatccgctggcaactaaacagcggttgaaaaactttcagcggttattgcgaaacgtgttaagtttgacgggattaatctttttagttgcgttctggttaagcaacgcaccgttagctcaagttgggattttgctcatcattaacgtgattgaaatctatctcttagttacttggtatttaaaattaagattagcttaaaaccttgatgtatcaagggttaaaaaggacttgacggattcaactttcgtctataaaatgtgattgttaagtcaaataataatgagtcattaaataaattttgagaggagtggggctgatggatttcgaacttgatgatggctgggacgtttacccgatctatgggaatacgaataaagctttcatgggcaaaaaaaatcaccaacgattgttcttaaagcgaaacgcctcgccgttcctagcggcgctgtcgatggaagaaattaccccgcgattaatctggacgaagcgtatctcaagcggggatacgctgacagcccaagagtggttgaatggtcaaactttaacgaagcaacaaatgcggctgcctgaagtggcgcatttattggcacgtgtgcacaattccgagttgcttcaccggatgttaagaaaagtcggtggtcagagtgtccgcccacaagactttattcagcaatacttacaagatttaccagatgatttacggcaccatccgttaatggcccgggttctggatgaattaagaggaaccgcacccactttaccggccactgattatcgcgtttgtcacggtgatcttaaccacaagaactggttactatctgatcgccaacaactgtacttggttgactgggattccgcacgatttgcggatccggcgtcagatattagtatgctactatgcgaatatgtcccgttaagtgattggcaacagtggcttagtgaatacggtgagactatgacgaccgccttacggacgcgagtggtctggtatgctaagatcaatttactattgaatatcaaagataattattatcggaatcagtaccatcagatgaaccatgaaattatctttttagaagaattatcgcagtacgaagtgtaacgacgagcaacaaaatcgccgcgagtcccagatggaattcgcggcgattttgttgagtaagcaaatgaagaaggagtcaatcaagatgcgtgtcagaaataaaccgtgggcgccaaagttaattgccgcccatcccgaacttattaccgaagatccaactcagctaaaaggccgctggcaaagccgttttgccaaaccccagccactccagattgaagtggggagtggaaagggccagttcatcattgaaatggctaagcgtcatcctgagataaattacgttgccattgaaattcagacctcggtgattgcgattattttgaaaaagctagtcgaggccccgttgcctaacctgcaattggcacatgcggacggtcaagcggtgactgcctttttcgaaccccatgaagttgatcgcttatatctgaacttctctgatccgtggccgaagtcgcgtcatgaaaagcggcgtttgacctacaagtcgtttttgagcagttaccgggaagtcttaaaacccaacggtcagatcgaatttaagactgataaccgggggctattcgaattttcattaacgagcatgaataactttggaatgcaatttgaacaagtttggttagacttgcatgcagttgccacacctgaggataacgtcgagactgaatatgaacagaagttcagtgcggcgggcccaatttataagattattgcaactttcccagcaaaatagactgaatgagaacagcgaaacgcgtcggcgatcgctgttttttaattgagtgtaattgtcggaaacatcaaaaatgagcttccagaattttaattccagaagctcatttttgatttttgatgcggatagtcaattgtgagttattaaagccggtaaatgtctaaaatactaccagtattggcatcggccaaaaactcgtactgtaccagctgaccatcttcatagcgggtaatgccgccatagtagacatccgtgcgcaatgcgaacttttgtaatggggattttttcatttcaatccacgagccttcaatcggtgcttccttcaaaaacgcgcgcttgacttggctaagaatttggttaggggtggggcggcgcaaccgcttgaacaggccgccaacggaaaagcccccggcgataccagccatcccaaccgctaacaagccgccatattgtaattgtttattcatgatgttgcgtctcctttcagctaacttgactaggaaatgttttatttaaatttagtataccaatgattgacgagaatacaaagaaaagtcataattaatcagtatgatttaagtaaaatacgctataataatatattgaacgctaaaatgagagtaaaggggtttcacatgttaattacaagttataatccatccgaattaggtgacacgttaatcaccattttacgaccagatgcggccacccaaacgattgaaacacatgccaatgtgacgcgtattagcgatgctgacagtggggaaaccttgggctataatttctttgacgtttccaagacgttaggcgacttagatgccaatggtcaagttcacttaacggccgaacaagttgagcaattaaataatttattaaaaaccaatgattttgaacctgaattagttttagacactgaccctaagtttgtggtcggctatgtggaatcagccgaagcacatccgaagtctgatcatttacagattaccaagacgaatgttggtttggatcaaccacttcaaatcgtgagtggttcacctaatatgcaggcggatattttggttgttgttgccaaggtcggtgcaatgatgcccagtggcttaattatttggccgggcgaattacggggcgttgagagtgatggcatgattgtttcaggccgagaattacaattaccgaacgcgccacaacggccaggggctttgattttgcccgccgattatcagccagtgggtgcgccatttgatttcaaacgcgctcagacgttatttaccgcttaatttgcagatattaaaaactaggatgattgaaaatgaaccattatgatggcccggcatttttccggaaatatcgatttaacaaaccacaagtgaataattcagcggccagtcaatcaactcctgtagcggcatcggctagtccacaatcgactgctggtgcacctagtgcggcgccaaaacggccagccagtcaaactagcgccaagcaggtgacgagtcaggcaactacttcgagtagcagtgctgcaactagtgcgaccctctttaacggtggcacccatgggacttttcacccatcccgggtaccagcccagcttagtgcggcgctgacaaatggcggtatcattcaggatcacgatgaccgtaattatttagaaattgaagcgagcttgcataagcggcccgagaccttcttattgtttgcggatgcagcagctaatgatttaccggctgttgatttgcaacaaccgctttctgatagtgggacggacacgagtcaagttgaacacccgagtgattcggcagttcttagtcaagcggaacggaagatggcttcaagtgttgacccgacaacagtaactagtcaggcagcatcgagcgtggctgctcaaacggtcgtggctaacacgtcacagaccggcagtgattccacggtgtccgcagcttcggcgatggttgtgcgaccaacggaagtgtttgaacctactactcctgaattagctgtgtcggctgcggcaattaatacgcctaaaaccgatgattcagtggtagtgacggctcccacggaagtatttgagcccactgacccaagtttagcagcgtcggcagccgccataaatgcgcctagcgcggtaagttcggcagtatcggcaggccccacggaagtatttgagcccactgacccaagcttagcagcgtcggcggccgccgtaaatgcgcctagcgcggtaagctcggcagtatcggcaggccccacggaagtatttgagcccactgacccaagtttagcagcgtcggcggccgccataaatgcgtctagcgcggtaagtttggcagtatcggcagggccgacagaagtgtttgaaccaactgatcccgcgcttgctgaatctgctgcaactgttaatgcggctgctgatcatgataaaatagaatctgctgcgactagtgcgacacccaagtcagcacatgggctaggactatccttaggggatattatgaccgctgagcacgatgcccaggcggacttagcgttatttaaggatcagccaacaacggcggcttctgcagcaccacagtcaagtactgcgcagactcgttcacacgttaacgaagaaccttatcaaccggttggcatgcggccaactagcacaagtcctgctgtgacgtcggcaacggccacgccagtcagcgttgtggcatcatccacggtcccttcacaagaaagtggggaagcgactagtgtgactatggcaccgtcacaggcggctacttctgcagttacaactagtcccgctttgtcagagacatctgcagtggcttcacaacctgagttagttcatagtggcggttcagcggcccccgtccttgaggataaagaattagcggcttatcatttgccaccgctgaatctgttgaaagcaccgatcgtggccaatgaatctgagatggatgattggatcgagcagaaggccagtgcattagatgaatctctggacgcatttggtgtcaatgccaacgttgtcgattggacgattggcccaaccgtgactcaattccaagtaaaacctgctcgtggcgtcaaggtcagcaagattaccaacttaaatgatgatttgaaattggccttggctgcaaaagatattcgaattgaagcgccgatccctggccgtaatacgattgggattgaaattccaaatgcgaaatcgcggccggtgatgctgtccgaagttttagattctgataaattccgcgacagtaagtcaccattgacggtcgcactcggtgtcgacttattcgggcaaccacaagtcactgacctgcggaagatgccgcacggtttgattgcgggggctacgggttctggaaaatcagtcttcatcaatagtatcctggtttcgattctgtacaaagcgaacccacaacaagttaaattgttgttaattgatccgaaggccgtagaactagcaccatacaacgagattccacatttattagcacccgtgatttcagaacccaaagccgcttcggcagcgctgaaatgggtcgttgatgaaatggacaaccggtatgataaacttgccgctggtggtgcccggaacattgagcaattcaacaaactggccgacgaacatgacgagccggctctaaaaatgccgtatatcgtgattgtaatcgacgaattagctgatttgatgatggttgcttctagtgaggtccaggattacattgcccgaatcacgcagaaagcccgtgcggcagggattcatttactagttgcgactcagcggccaagtgttgatgtggtcactggtttgatcaagaataatatcccaacgcgggtggccttcatggttgccagccagatcgattcgcggacgattctggacgcgagtggggcggaacgtctgttgggacgcggtgatatgttgtatcttggcaacggtcaacccgcaccgattcggttgcaggggacgttcgtggacagtgagattgacagtatcactcagtttgtccgtgatcaggcagcaccgcactatgaatttcaaccagacagcctaatgaagcacgaggaagcagcacgcaatgaagatgacttgatgcctgaagcattggcttacattgctgatgaagataccatgtcgacatcgaagttgcaacgaaacttctcgattggctataatcgggcggctaatattattgatgatttggaaagtcgcggctacgtttcagcagctaagggttccaaaccacgagatgtttatttcacggcggcagatttaactaaattacaagccaattcataattaaaaataaagcgattcacctcatgattgatgaattgtgaatatgggagattattatcataatggataaagcaacggtttattattttgttgggatcaagggctctgggatgagctcactagccttgattttacatgacaagggttaccaagttgaaggctcagatattgaacaatatacgtttacgcaaaaaggtctagctgcagctggcattaagatgctaccgttttccgaagataacattcgcgaaggcctcacagtgattgcggggaactcatttactgatgaccatcctgaaatcaaaaaggcgcgtgaaatggggttgcccgtttatcgttatcatgaatttcttggaaaattaatggaaggcttcacgagtattggtgtggccgggactcacgggaagacgtcgacaactggtttgttgtcccacgttttgagtcatattgctcccaccagttacttgattggtgatgggaccggtaaaggcacccctgacgcacgtttcttcgtttttgaagcggatgaatatcggcggcacttcgttgcttaccatcccgattatgccatcatgacgaacgttgactttgaccatcctgattactacaaggatttagctgacgttcaatccgctttccaacaatttggcaatcaagtgaagaagggcatctttgcttggggtgacgatgaaagtttacgacacctcgatgttgataccccaatttactattacgggacgaatgaccgtgacgactttcaagcggttaatatcaaacgaacgactaaggggtcttcatttgaagtgaagtatcacgatgaatcgttagggaaatttgaaatcccattgtttggtgaacacaatgtcttaaacagcacggctgtcattgcggtttcttactttgaaaaggtgaacttggacgaaattcggcgggaactcctcgactttagtggggttaaacgacgtttctcagaacatcaagttggcgatatggtcatgatcgacgactacgcacatcatccatcagaaattaaagcaacattggatgctgcacgccaaaagtatccggataaggaaatcttggccgtattccaaccacatacgttctcacggacgaaagcattgatggatggctttgcagccagcttaagcaaggcagatcacgtctttttgaccaatatcttcagttctgcccgtgaaaaatctggtgatgtttcctccaaagacttagctgctaagttacccaatggtggtgaaattatcacgaccgatgacatgtctgctttaacggcttaccacaatgccgtcgctgtctttatgggtgctggtgacattcaaaagtacgaaaaaatttatgaagaccaaatgaaataatttttaaaaaagcggcccccagcagggccgcttttttagtctgtctttaaattgatttagcgtaaaacggcgttagcatccaagatgaaaccctatgagagatgttagattattgctagacaacagttgtgcgacctattttgaccttacaagttttaatggaacttatgcagtcgataaataaagcaccaatgaggataattcactagaatctccgtcattggtgttttattagtgtgtatgatttctaaggattaaccacgtggttagtgaggcaggtgcagtagtcttagttttgttgcttctgggctttgtttaacattttcttagcttcacaatcatagtcgcaggccgcacatttgccctttttagcacgtttgaccacgcgataaatctgatagccagcagctccaataattagtgcgataattaagaaattaacgaataatgccatgtgaatcaaactcctttcagataaataattgaccaacttggtaaatgacgaaggccaaggtgtaagcaatgaccaaactcgagcagacggcgtaaacagcccacttggtcgatccagtctcggacttgatggtcccaatcgtggcgaagcacgggacatatagcaagatgaagacgagcatcgcgtatgcggataacggtgtgaaaaagcgccccatcatggcaatcaagccggcctgatttgcgctgtggaacattaccatcatactagagctgatgacttctttggctagaatcccagtaaagagggctgagataacttgccaagcagtcacaccgagtggcgcgaacagcggtaatagtgttttgccaagtgtcgcggcaaagctgttgtcgatgtcgctgactaagccgctagtgccgaatgaggaaagtaaccaaatcaagaccgtaccggcaaaaatgatagtacctgcctttttgatgaaccctttacccttatcccaggtgccacgccaaataatgtcagcccggggaatatgatactgtggtaactcaacgatgaagacggaactatcatcgacgttgaaaatcagttgataaaatttagccataccgagggcgaccgcaatgccaagaaagtaaatcgacaagacaattagggcctgatttttcggaaaaaaagcggccacaaataggctgtagattggcagacgggcggagcaactcataaatggggaaatcagcgttgtaattaagcgttctttaggttgttcaattgtccgggcggccataataccagtgacgttgcatccaaatccaataattagggggataaatgccttcccgttgagtccaatcatctgcatcaagcggtccgtaactagtgctgctcgtgccatgtaacctgaatcttccaagattgaaatacaggcaaacaagacaaaaatttggggaataaagacgagcacgccaccgacccctgcaattaggccgttaacaatcagtgagcgcaagaccgggatggctccagccatggtcaaccagtgactcacggtggtggatagtggtccggagacgaagctatctaacaaatctgacaggggcgtgccgacccaatcgaaggataatttgaacatcaagtagaagattcccacgaagacgggtagccctaagaacggattggtgacccacttgtcgattttagcagtcatctcgacgtggctggtgcttgccaagttttgactagcgctggctaaggtttgctcaataaaatctagtcgggtttggaagatctgctcgtcgaatttttgagcgtcgtaataagcggcttgactagtgagtggtgtcaatcccatgtgtttcgcgtaggctcgaattggtttattttgattaataaattgaatcgtcagccaccgtgcgaagtctgctgtcaaatcaaattttttgatgagctgttggctagcctgacgaatggcttgctcaatcatgaaaggatagttgagtttgagcggtgtcgcggtcggatggggacctgccaataagtcttcgcgtagctgatgcagcccttctttattgcgggcgttagtcgctttgatctgacagccaagttgttcagctagcgtgtcaaaatcataataatggcccgtccgtttgaggtcatcaatcatgttgagtgcgataatcaccggtgcgccaaattccaacacttcgatcgacagtagtaagttacgcttgagctgactcgcgttggtcacgttcagaattagatcagggtggttatgtagcagatagttggtgacgactgcttcatctttggtgattggattaagtgaatagactccgggtaaatcgaccatttcaacttcagagtgccgaatccggcccatcttcttctcaacggtcacgccggtccagttaccgacgtacgcgtatttatccgtcagttcattgaatagcgtggtcttaccagtattgggatttccgagcaatgcaaccatcgtcatcttaatggcctccaatcaacgtttgaaatacggtgtaccgaatcccaatccgttgttgatcaatctgaacaattactggtccgtgaaacggatagtagcggacaacggccagcggactgccgacatgtagccctaagctgtgcaatcgttgaacggtctgattatccaaacctgtgaattgttgaatatgtaattgtgatgtattagtaacggattgacttagcataaggctcagtcctttctgaatattccaatagtgaataattcatcaaaaatattatacctacatcatagcatgaaagggcttttattaatatggggaaaagccttattttcttttgaaatgaaaacggttatactctaagtatagaatacaaaaaggccgatgttacgctatttttgttgaagccgttgactaatcattatatacggaaggaataacggcttgggtaataaattcaattgttggaggatgatttaaatggcaaccttggaagttaaagatttacacgttgaagtgacggatgatgagcaaaaaaagtctcgtgagattttaaaaggcgtcaatttatctatgaaaactggtgaaattcatgccattatgggaccaaatgggactggtaagtccactttatcacaaactattatgggccaaccggcttatcacgttactcagggtgatatcttgttgaacggcgaaagtatcgtaaacatgccagttgatgaacgtgcacgtaagggactcttcctcggcatgcagtatccagctgaaattcaaggggtcaccaacgctgaatttttacgggcagcaatgaacgcacgtcgaccagctgatgatcaaatctcagtgatggcctttcttaaagaactcgacaagaacttggcactacttaatatgagcgaatccatgacggaacgttacctaaacgaaggtttctccggtggtgaaaagaagcgtaacgaaattttgcaattattgatgatcaagccatcattcgccttattggacgaaatcgattccgggcttgatatcgatgcgttacaagtggtttctaagggtgttaattcaatgcggggcgataatttcggctcattgattatcacgcattatcaacggctgttaaactacattgtgcccgatgtcgttcacgtgatgatgggtggtcgaatcgtgaagactggtaacgccgacttagcaaagacccttgaaaaagaaggttatgctggtttacgtgacgatttgaacattgatgtcaaacttgttgacgacgaagattagggggtggcagtaatggaagcaactgctgattatgaaactatcaaaacaacgctagctgcggctgctaacgaacatggtgaaccgcactggctcgttgaacgccgtttagcggctttagatgcgatgcaaggcctagcggttcccaaagctgatcgctttagtattcgcgactggccactgacgcccaccgaccaaccactaaagttcagtcgttcggatcgaactttagcaactgatgtaacggccgaagctggtcatatccaaatcgtacaagttgggcagacaacggtgaccgtcaatttgcctgatgaactagatgatcagggtgtcattttgaccgatatgttcacggcttttcgcgaacatccacagctaactgaaaaacattttatgggcaaagtcgtcaaaactgacgaggaccggttgaccagctaccataccgcgtttttgaacgccggggtcttcctctatgttcctaaaggggttactgtcaaagaaccaattgagatcaccacgattcaggatagtacccgcgtgcaaccgttaattagtcacgtcttgattgtggctgaacaagacagtcatttcgcagtaactcagcacctgacaacgaagggtgacgtcgataatatcgccaactgtgttgtagaaattttggcacgggctgacagtgaagtgcatttttcagcgttcgatgaactcggggccaacacgactgcttatttgaatcggcgggccgcgatcagtcggggagccaaagtcgattgggctatcgggatgatgaataacggtaacactttcggggactttgactcggaactgatcggtgagggcgccaaatccgatgccaaggtcatcacagtgacgaccaaggctcaggatgtctgtgttaatacgcgggtcactaaccgtggtaagaagactgacggcaatatcgtacaacgtggggtcattatggaaaagtctaacctgatttttaacggaatcggtcacattattcacggggcctccggtgcacatgctgaacaggaaaatcgggttttgatgatgtctgatgatgcccatggtgacgcgaacccgattctattgatcgatgaaaatgacgtgttagctggacatgcagcaagtgttggtcaaattgatcaaaatcaaatgtactatttgatgagtcgcgggattgataaaccacaggcccaacggttggttattcggggcttcttaagtaccgtgattggtgcgatcccatcgaagactgtccggactcgcttaacgaacacgattgaaaggaagcttgaagatggcatccaattttgagacgttacggtcagattttcccattctaaaccaacaagtgaatgatgaacgacttgtctacctggataatgcggcgactgcgcagcgccccaaccaagtcgtggatgcgctcgttcacttttatcaacacgataatgccaatgttcatcgcggtgtgcacaccttagcagagcgggccactagtcaatacgaagctgcgcgcgccaaggtgcaacggttcatcaatgctgcaaaaacggatgaaatcgtcttcaccaaagggacgacggatagtctcaatctgattgccagtacttatggcgaagccaatattcaagcgggtgatgagatcgtcatttccattatggagcaccatagtaatttaattacgtggcaacagttagcattgcgtaagcacgccaccttgaaatatattgagttaacgacgactggtgaattggacatggccgatgctgccaacaagattacggatcgaacaaaaatcgtttcagtgacccatgctagtaatgtattgggaacggtcaatccaatcaaggcgttagcacgattggcgcatcaacacggtgccgtgatgattgcggatggggcgcaagcagcccctcatatgccggtcgatgtccaggcactcgatgttgatttttacgcattttcagggcataaaatgctaggaccaaccggtattggcgttctatatggtcgtgagaatttattagctacgatgccaccgtatcaatttggtggtgagatgattggctttgttcaccgcgatgacagtacctgggcggaattaccgtggaagtttgaagcgggtactcagaacattgccggtgcgatcggcttgggcgcggcggttgattatttgacgcaactcggtatggatcaagttcagcaacacgaacagcaattagtcaattacttattgcctaagttgattgcaatgcctggtgtcacggtctacggtccccaagatccccaacatcatacgggcgtcatcgcctttaatatcgacggtttgcacccgcacgacgcggctaccgcgttggatatggaaggtgtcgccgttcgcgcgggtcatcactgtgcacaacccctgatggcagcgctcggcttagtagcaactgcacgggctagtttttacatttacaatacacaagcggacgctgatcaattattaacgtcactccaagcaacaaaggagtttttcgaacatgggactgtctaaattaagtggcttatatcgcgaagtgattttagatcatggtgatcatccgcatcataaaaatgcgttgccaaacgcaacacatgccattacgttgaaaaatccaacttgtggcgacgtcgtcaatttggctattcaattggatgcgcatgatcaaatcgaagatattggatttacgggtgagggctgtaccatcagtcaagcatcggccagtatgatgacggatgcggtgatgggtaagtcgaaagaacaggcattggcaatggctaagacattttcggatatggcgattggcaagcaacacccgcaggccgatatggatgccttagaagacgccgcaattttatcgaatattatgcaatttccggcacgaatcaaatgtgccacgctagcttggtgggctttgcaacgggcattgcttgctgaaaatggcaatgaggaggaatcagaagtatgagtgaagtacctgacgtggtcaaaaatgaccgtgattatgaatatggatttcatgacgatgtcaaaccagcatattcaactgggcgaggattaacggaagccacggtgcgcgaaatttccgcggcaaaacatgagccacaatggatgttggattatcggttaaatgcctatcatgagtatttaaagatgccgatgcctaagtttggcccggatctcacgaaactcgacttgaaggacatgctgtattatcagaagatgaccgataaaaagttccgtgactggaaagaagtcccagctgacttgaagcggacgttcgaccggttaggtgtgcctgaagctgaacggaaatacttagccggttcatcggcgcagtatgaatctgaagtcgtttatcacaatatgcgtaaagattttgaaaagttaggtattatttttaccgataccgatacggcgcttcacgattatccagaactgttcaagaagtggtttgggaaactcgtcaaaccaaccgataacaaatttgcggctttaaacgcggcggtctggtcaggtgggtccttcatttacgtgcctaagggtgtccagacgaagacgccaattcagtcatatttccggttaaatgctgaaaactcgggtcagtttgagcggactttgattatcgtggaagatggtgccagtgtcgactatgtcgaagggtgtacggcccctaattattcttcagatagtttgcacgcggccgttgttgaagtcaatgttgagcccaacgcttactgccgttatacaacgatccaaaactggtctgacaatgtttatagcctggaaactaagcgagctgcagcggccgaaaatgccacgatggaatgggtcgatggaaatttaggttcgaaggttacgatgaagtacccaagcgtttatttgaatggggaaggtgcccgcgggaccatgttatcgatcgcggttgccagcaatggcatccaccaagattctggtgctcggatgattcataatgctaagaatacctccagttcgattgtttcgaagtccatcgctaagactggtggtgcgactgattaccgtggaaccgtgcgttttgccaagcattcagacggttccaaagcgcatgttgagtgtgacacgatcatcatggatgaccagtcgtcttccaacacgattccgtataatgaaatcgacagtgctaacgtcgcgatggaacacgaagctaaggtgtccaaaatctcagaagaacagctctactacttgatgagccgaggaatttcagaagctaaggcaaccgaaatgattatcatgggattcgtagaaccatttacgaagcaattaccgatggaatatgctgttgaattaaaccggttaatcagctttgagatggaaggttcaatcgggtagtaagggggattggtcaagctgatgttaaaataaaacttgagtggcatgcgagattgcgattcgagttttttggttaaatgattgttgatgaatgttagccattataatcgtgccagctaggatggttgataattgtagtaatttaaaattgtatctcggttagtgtttttatcatgctgattcgccttttcgttaatattggcgacgtactttattataaactaggattattaacgtatattctaacaatggtataattaaaaacagatttaaacagacaggagtgtggcagaatggcagacgaacttggcgaggataaggccctctcacccgttgaagacgcggtcatgaagtcgttagagcaggtgattgatccagaactgggcgttgacatggttaaccttggtttgatctatggtgttgacgtagacgataatggtagctgcacggtaacgatgacgttgacgacgatggggtgcccattaggaaatttattggcaagtcaaattaatcaagcaattatgagtgtggatggtgttaagaattgtgaacttgacttggtctgggaacctgcttggggaattgataaaatgagtcgttttgctaaggttgcccttggcattcatggctaacgggtgagacaaggtggtgtgcgatggatattgaaaagtttattgcccggcgaaaagctttaaaaatttcacaagtcaaattatcaaacggaatttgtacgcaggcgactttaagtaagtttgaacggcgtgggcgagtaccagcattagcaattttaaatcagctctgcgcacgtctgggattgacagttgatgatctaagtgaaaaccaggctaattcagtgacccaaattcgacagcaacttgatgagattgaacggcgactgatgatggaagattatcaatcagtcctgcaatcattggtagacctgaaagttgagcaaattgatgcggtaccttcacggatgcaatattactatttatgtggcatgctaagttcgttgattaatggaacagccagtgatatttgtttttccttctcgcaaatcgttgatgatttggatagggctcaccaaacaattttcacaccgctggcttatgtcggtctgggtgtcatgtatggccggttagctgagcctgagaaagctcaattttatttcaagagagtacgatactatgtcgagcacgctggctcatcaggatatgcaaatgattacttacggctgttaaccctaatcttttatacggcagagtattacgcagttagtggtgatttcgtcacaagtaatcgtctaatagatgatggggtagcactttgctcagatgaacatgtcacgtattacttaccaagattgaaatacttagcgaccgagaatgctgttaagcaacaactttcggataaattgattaagcggttaatgagtgaaacagaagcttttgcacggattaatcataatcaagttgttgaggttaaggtagctgcattgcgacaacgatatttgcagggcatttctgcttcagaaaacaattaacaaaacaatggctagatttagtgttttattgtagtttccaacatgctaaaactaatcaatgctttgtacattaaataataagaagtcccacactagcaagtcaatactagtgtgggacttcttatttagaaagttatgtatgacgccgcctgcccctaaaaaatcttccccggatgtcccgcaaaaagtcctaccgattgaagttctattataaacgcttatggtgtcctcattccggaaaatcctaatgtaccggtaatccattaaagacaatgattgaataggattcaattaaacataagaaattcttattaaattcacaggcacaaactattttaccttctttgactaatttgatagacttaagttaagaaagttgaggtgactgattgagatggctagtcataggcaaatgattgacaaactagtgtggtgttgttactagcgcagtctgcgttagtaacgatgcacaaactcaatttttaatcttaactcggaaaaagtaacgagtagtcaatttttaggtgaaagagggattttatgaacaattttcaaaatgacccacaaccacggaccatcaacacacaagttggcctccgtagtttcctaactaaaatgtatgggtttatgacaatcgccgtgttagtttcggcctttaccgtttacttagcgatgaccacgttccaagcacaaattaatgccgccttttcacaacacccattcatcttcttgatgatcttcattgtcagcatgtttgtgatgattggtgggattcaagtcaacgcgacacgcaatccagcgatgagcttcaccttactgatgctctttgccatcatctttggggttgaaatgtcagtgaccttgtccttatacacgggtgccgttatcaccggtgcgttcgttgcagctggagctgtatttgcgaccatggcggtgattgggacgacgactaagcgtgatatttcacgtattgggacgcacttgattgcagccttgatcgggttgtttgtcgcttcactggtcaatatgttcttacaaagtgccatgattagttacatcttttcatacattggtgtattgatcttcgccggcttatccatgtgggacgctaaccggatgcgcaacatgtatttgcaatatggtgaccaggtttcatcgactggtttggccgttactggggccttacaattatacttggacttcgttaacttgttcctctacttcgtccaaatcttcggtggctcaagccgcgactaatcattaagataattattaaggattatgaccaagatgtcataatccttttaatttaccgaaaatgagttatttcacgggttttcggtggaccgaactcccgttttacttaattgtttggtacaattataagggtaaataattagtcgttcagcctgtactgacaggcgctgcgaatcagaccgccaatcgagtggtattaatggtctgagtgacggattttcataaaaatgatgatttaaattaagagatggggagcaaactaatggcaaaaaaattattactgattgatggtaacagtgtggcatttcgggcgttctttgcgttgcatagtcaactggaacggttcgtaaatccagacggcctgcataccaacgccatttatggcttcaatacaatgcttgaccacatgatcaaggcagtcgaacccacggatatgttagtggcttttgatgcgggtaagaccacgtttcgaacagccatgtacgataattacaagggtggccgggctaagacgcctagtgagttttctgaacaaatgccgtatatcaaacagctattagacgcgtatggtatcaaacattatgaattaaaagactacgaagccgatgacattattggcacactggccgctcaagcggatcaaaccggctacaccacgacggtcgtcactggtgaccgtgatttgacgcagttgacgaccgagcataccacggtggccgtgaccgttaaaggtgtttctgaagtggaacactatacgccggcgcacgttgaagaaaagctgggcatcacaccggcacaaattattgacatgaaggggttgacaggtgatacctcggataactatccgggtgtcaccaaggttggtgagaagaccgcccttaaattactcaaacagtatggtacgatggaaggcatttatgaaaacatcgatgccatgaagcagagcaagatgaaggaacatctgattgaggatcgcgaacaagcggcgcaagctaaggtgctagcaacaatcaagcgggatgcgccgattgatgttcaattggctgatttatcctatgatggcccggatcttgaccagctggccgcgttttatcagaagatggactttcaatcatttttgaagaaattacacctacagtcggacgaaccagcaacgcccattgattataccgtcttgacgaaagctaacctgacggaattgcaacaatttaccgaccacgtggacttttacttggagatgccaacgccaaactaccacacgtcggcctttgctggctttgccatcggagcggatgatcactggtacatcagtcgggatgtggaattattaatgcaaccgactgtggctgacctcttgagtagcacaacgattaccaaggacgtttttgatatgaaacgcacgacggtcgggcttaatcgtttgggtattcagctaggtaaagtcgattttgatctcttactcgtttcatacttattagatacaaatgataacagtaacgacttgggaagtttagctgagcaacacgggtacactgacttgccgagtgacgagaccgtttatggtaagggcgttaagcgtgccattcctgaagatgatgatgtctactttagtcatctcgcccggaaattggccgcgatcgctagtttgaagccacagttattaaaggaattggcagccaatgagcaggatcaactttacgatgatattgaaaaaccgatggccaatgtcttagctcagatggaaatcgccggcattacggtcgacagcagtcgacttaaagccatgggcagtcagtttacagaacggttgagtgaaattgaacagacgatttatcaagaagccggtgaagagttcaatattaattcacctaagcaactaggtcacatcttgtttgaagaaatgaaattacccgtaatcaagaagaccaagacagggtattctaccgccgtagacgttctagaaaagttagcaccggaagcaccaatcgtcgctaatattttacaatatcgtcagatttcgaagattcaatcgacctacgttgtcggtttgttagatgccattcattctgctgatcaaaaggtgcatacgcgctacttgcaaacgttgacccaaaccggccggttgtcgtccgttgatccaaacttacaaaacattccggtgcgcttggaagaagggcgtaaggttcgacaagcctttgttcctagtcatgaaggttggcagattttctcgtctgattattcgcaaatcgaattacgggttctcgcgcatattactgatgatgaaaatatgcaggccgcttttaaagcgggtgatgatattcatgccgcaacggccatgcgaatctttcatttgaactcagctgaagaggtgacgccaaatattcgacggcaagccaaggcggttaactttggaatcgtctatggaattagtgattacggcttgtcacaaaatatcggcattacgcgtaaacaggctcgcagctttattgacgcttacttcaaagaatatccgggtgtcaaaaagtatatggatgaaattgtccaaacggcgaaaaaacaaggttatgtggaaaccatttcacatcgacgccggtacttgccagatattaattccaagagcttcaaccaacgctcattcgctgaacggacagccatgaatacccccatccaagggagtgcggctgatattatcaagattgcgatgattaagatgcaagataagttacaggctgcgggtttgaaagcaaccatgctgttacaagttcatgatgaattgatttttgaagcgccaaaagaagaaattccagttttagaaaaattagtgccaagcgtgatggattccgccgtacagttagccgtaccgttaaaggttgagagccactacggtgatacttggtacgatgcaaaatagggggaaccaccatgcctgaattacctgaagttgaaactgttcgtcgcggcttaaatcgtctggttagcggggcaacgattgctagtatcgaggctttttggccgaaaattattaataatgatgtcgatagtttcaaacagcgtttagccaaccaaacgatccagaccattgatcggcgggggaagtatttattgtttcgctttagcaatggtctgacgatggtgtcgcatttgcggatggaaggcaaatataatgttgtaccgcgtggtgaagatcaaggcaaacacacgcacgtgatcttccatctgaccgatgatcgtgatttgctgtacaacgatacgcgtaagttcgggcgaatgacgctcgtgccgaccggtgaagaaaaaacggtggcgggattgcggacaattggcccggaacctgttgctgaacagttaacactggcttatatgaccgccacttttggcaagtcgaaaaagatgatcaagccactattattggatcaaagtaagattgcgggcattgggaacatttatgcggacgaaacgctatggatgagtaagattcatccaatgcggcctgctaattcattaactactgatgagattgcaacattgcgccaaaacattattgatgaaatggcgatggcaattaaaggtcacggcaccactgttcattcattttcaacggcatttggtgaggccggtcagtttcaaaatcacttacacgtctatggtcgtgaaggggaaccttgcgaacggtgtggcacgattattgagaaaatcaaagtggcacagcgagggacccatttttgcccgttagaacaacggttgtaggtgatcaagatgacaaagttgattggattgactggtggcattgccactggtaagtcgactgtttctaagctgctggcaactaagctaccaatcgttgatgcggataaaattgcgtggcaggttgaagggccaggccaaccgacgacccaaaagattgtggcgcactttggtcagcaagcagtgctggcagacgggcggctgaatcggccatggcttggccagttggtttttaacgatgctcaagctttacaagccttaaccgcaattacacggttaccgattcagtacgcgatgttcgaagcgattgtcgcggcaaaccagcaacagcccgacgcaattattttagatgtgccgttgttatttgaaagtggctggcaacatgtttgtgatcaagtgttggttgtgacggcatcacccgccgtagtattgcagcggttgatggcgcgtaaccacttatcgcaacaggcggctcaggcacgaattgacagccaaatgccacttgcacagaaggtcgcaagggctgacgttgtcattgataacggggccaacattgataaaactaaagcagccgtgttaaaatggctgaaaactattactaaataaagaaaaactgattgttagttgttacaaggggtgagaagtctatgcaatgtccacattgtcatcataatggctcccgcgtggttgacagtcgaccaactgatgatggtcgcgtgattcgacggcgccgggaatgcgaaaactgtggattccggttcacaacatttgaacgggtcgaagccacgccattattagtcattaagaaaaatggtgcccgcgaagaattcaatcgtgaaaaagtcttgcgcggaattattcgctcggccgagaaacgacccgttagcatggaaaccatgacgggcgtcgttgatgatgttgaaaataaggtccggtcactgggcgaaaatgaaatttcaagccaagttatcggcgagtatgtcatggagcaattggcagatattgacgaaatttcgtacattcgttttgccagtgtttaccggcaattcaaggatatgcacgtcttcttgaatgaactccaagatatgatggagcgtgataaggtcaaactggcaaaaccgtcagcgaagacgacccacgcacctaaacgaaaaaaagattagtgaaaaagaatggtgaacaacatgccaaatgatgaacccttaacacccaaaactgggttagtggtcccgcaagcaccagcgctcagtgcggcgcaacaagctgtattggcggaattatacttgccactgatggggccattggcatatagcttgtacgcggcgttacgtagcttacagagcagcgagaatgagctgagcaatcgacgcagtcacgcggaactgcttggcatcctaaatgtggacttgccgacggtgttagcggctcggcgtaaacttgaagcaactggcttgttgcgcagctattatcaacaagatgaattgggtgccatgtacatttatcaattacaagcaccattactggcgttacaattctttgcggatgatctattgagtgtcctattgttagatacggtcggtgagttacgttatcaacaacttgctggcgattttgcagcacagccgattgacttgacggctgccaaagacgtgacggcaaatatcttagatgtgtttcacgttgatagtcaaaaagttacgacgccacctctttcagtgcaaaaggtgcgcgcccaattggcggccaatgaaccggccgaggatcactcgcccgtgctcagtgacgatgactttgactggcaactgttggggcaaattttaaagcagaactatgttgatctcaaacaggttgcgagttcacggcaactgatcattacggaaagtcgggtctacggcattagtgagattgagatggctaagttaatcagtgaagtggccagtttaacaacgggtcagtttgatgaaaatcaattgaaattattgattgcgcggcgctatgaacggcccgcagtttcgagtcagcaggtcgctacggaagcaacggttgcaacgacgaccactaaggataacaaggcttcagcacagctctcaacggctgagcagcaactcgtgacgtatgctaagcagacagcgccgtatgactttttatcagctttgaagcaggagaaacatggttttgtgacgagcggtgagaaccggctagttcatgatttaattggtcggggggtattacccaatgccgtcatcaacatggtgatctactacttattgcaaaatcgggagttagctgcccttaatcgtaatttgctagaaacagtcgccaatgattggcaacaacacggcattacgacgccggaagcggctttgatgcatttgaagcaacgtaaacagccgaaatcaacaccaacacggcgcaagaacaatcgaccgacgcgtaaggagattatgccaaagtgggcccaacaacagcaacagactgagagtggtaagcaaccagctcagaccggtaaacaaattactgctgcccaacgcaaacagcttgctgatcgactagcaaagcttgagacaaattcggaaaaggaggactaaaacatggagaatatctcagaaacactccggacgttaatgaatcggaaaaacttgaatcatcggtatgaggcgttaatgacagctgtgtaccaagatccagatgttcgccagtttttagctgctcatcaaaacgaattatcttcggatgcgctagaacgttcagcggctaaattatatgaattttgtgaagagaaacgtaaaattgcgcggcacgagccaactcaagcacctgggtatcagccgacattagtgatgagtaatcacttgattgacattgcttatcagccaacaccacaaatgcaagaacagcaagctgctcacgcattgcaacagcgggttcgatcaatcagcatgccgaaaaatattcagacggcggacttaaagacgtatgatcaagatggtgaccgggcgacagcattaatggcagcacttgattttattgatgcctatacacaagcgcccaagcgttttcaccggggcttatatctctacggctcatttggtgtcggtaaaacttatttactcggtgggatggcgaacgcgttggctgctaagggtttcaatacgaccttgattcattttccgagttttgcggtcgagatgaagcgctcaattagtaacaatacgtcggcggataaggtcgatgcgattaaacgggcaccgattctcatgattgatgatatcggtgcggatgcttcgtcgacttggattcgggacgatgtgctcggggttattctggagtatcgaatgcaggaggaactgccaacttgtttctcgtctaatttttcgatgcaagaattgcaagatggttatttgacgctctcacaaaagggtgatgaagaaccagtcaaagcgcagcgaatcatgcaacgggtacgttaccttgcgagtgagattgagatggtcggtcgtaatcgacgactcaatcccgatgcttaaaatcaagagttgacttttagtttaaaagtggtttaatgaaaacagatgcaaaagacacgctttgtttaccatggattgcagagaccaagaccttgttctggaagtcttggaccgggtttacgaagataccacttttgtgaacatgctcaattgagccggaacgcttccgttattagcgctaatgagtcagtgtctttgatgacactgaaaaatcgggtggaaccacgtcaatgacgtccctaatgctagttcagtctggcattagggacttttttgtcgtcccggcgcggtgttttggtgagtgggtaaattttaaggagagtgtcaagtatatggcaagtattaatgttaagttcccagatggtgctgaaaagcaatttgatgccggcgtaacgacggaagaaattgcaaagtcaattagtccttcattggctaaacggtcggttgctggtaagttcaacgatcagatcgtggactatcgccaaccactgacaaccgatggtagtatcgaaattatcgctgctgatagtgaagacggcctcaatgttttacggcaaacggctgcccaagtattagctaacgcggttaaacaattattccctaacattcattttgggagtggtgaagggaatgccaacggtttcttctttgataccgacaatcctgacgaagacggtaaacaagtcagtgaagatgatttggaagccatcagtgataagatggctgcaattatcaaacaagatttaccaatcgaacgcgaagtcttatcaaaggctgacgctttagctttagttggtgacaacccttaccaacaagacttagttaacgaacgtgccgctgccaacaatgatcaagtcgttgtttacaagcaaggggacttcgttgatttatctgacggtgcccaattggcttcaacggggaaagtcaaggtcttcaagttattatccgttgccggtgcatactggcaaggtaagtccagcaatccaatgttacaacggatctacgggacggccttcttaaagcaaaaagacttagatgctgacctcaagcggcgtcaagaagcccgcgaacgtgatcaccgggtcattggtaacgaattagacttattcttcgttgatcctaaggtcgggaatggcttgccttactggatgccaaatggtgcaacgattcgtcgccaaatcgaacgttacattatcgacaaggaagttgcaaatggctaccaacatgtatacacgccagttttagctaacttggacgtttacaagcaatctggtcactgggaccactaccgtgaggacatgttcccaccaatggacatgggtgacggcgaacaattggaattacggccgatgaactgcccatcacatatccagatttacaaccatcacattcgctcataccgtgaattaccattgcggatcgctgaactcggcatgatgcaccgttacgaaaagtctggcgccttaactggattatcacgggttcgtgaaatgactttgaacgatggtcataccttcgttgcgttggatcaaattgaagaagaattcaaaaaaatcttgagtttgatggttgaagtatacgaagactttgacatttctgattaccggttccgtttgagctaccgtgatcctgaaaacaaggaaaagtacttcgatgatgacgctatgtgggaacgcagtcaaaagatgttgaagtccgctatggatgatatgggcttggattacttcgaagctgaaggtgaagctgctttctatggtcctaagttggatgttcaaactaagacggcccttggtggtgaagaaaccttatcaactatccaattggacttcttgttaccagaacgctttgacttgaagtacgttggtgctgatggtgaagaacatcgtccagttatgattcaccgtggtcttgtttcaacgatggaacggttcgtcgcttacttaactgaaatttacaagggtgctttcccaacctggttagcacctaagcaagtaacaatcatcccagttaacaatggtgcgcacggtgcctacgctgaaaccgttcgtcgtcgtttggcagctgaaggtgttcgggtaagtatcgatgaccgtaacgaaaagatgggttacaagattcgcgaatcacaaacgaagaaggttccatacttgttagttgtcggtgaccaagaagttgctaacgggagtgtttcagttcggaagtacggtgaagaacggactgaatccgaagccgttgacatgttcattggtgccatcacgcaagaaatcaagcattacagtcgtggtgcaagcaaataattaacagccaatggcatcaatattgattgatgggttgacaagggccgtggttcttgttaatatattggagttgagaaaaaaagcagaagcacccgcttctcgccttggtgaccagagtcatcgggcagatgaacgatgaattgattcccattaacggggttgagcgggcgtactatgcgcccgctctttttgtgaatttctctaaaatatttcggaggtgaattaccatagctaaagattcaatggttaatgacggcatccgtgctcgcgaagtacgtttgatcgccagcgatggtgaacaattaggtgtcaagtcacgacaagaagcaatgcagattgctgaagacgctagtttagatctagtattggttgcgccgaaagcgaaaccacccgtggccagaattatggattatgggaagtaccgtttcgagcaacaaaagaaggatcgggaagcccgtaagaagcaaaaagtggtcagcatcaaagaggtccgcttgagcccagctatcgacaccaatgactttaacacgaagctgaaacatgctgaaaagttcttgtcaaaaggtgacaaggttcgcgtctccatccggtttaagggccgcgctattacccataaggacattggtcgccaagtcttaaatcgaatgattgaagctactaaggaattttctacggtcgaagcctatcctaagatggatggtcggagtatgttcctagtactagcaccaaaaacagataagtaatttctaggaggattattgattatgccaaaacaaaagacaaaccgcgctgctgcaaagcgtttcaaggtaactgctaagggtaagattaagagcgccaacgcttttactagtcatcgtttccatggtaagactaagaaacaacgtcgccaattacgtggtacggctattatcgaaaagccaatggtcaagacataccacaagttattacaaaaataattcacaacgttttagttaaatctaggaggaaataacatggctcgagtaaaaggtggaactgtaacacgcaaacgtcgcaaacggattttaaaattagctaagggttaccgtggtgctaagcacatccaatttaaggttgctaaggaccaagtaatgaagtcatacctatacgccttccgcgatcgtcgccggcgtaagagtgacttccgtcgtctttggattgcccggatcaacgcggcagcccggatcaacgacatcagctacagtcaattaatgcacggtttaaagttagctaacgttgacgttaaccgtaagatgttagctgatttagctgttaacgatgctgatgctttcaaggcattggttgacactgctaaaaaggcacttgcttaatttaaaacttaattagggcttgctctaatgtttgaacgaccgtcatcctgtatgggtggcggccgttttttttgacgcttgattaagggaacacgattcctggacaagatggttcggtgtgttgacgtccttactgaatcttgagattgatttgacatattattgtgatatagtaacgatgtaagcgcttgcttatatgttgattaattatttggctgggagctttggagaaggggtgtcatcatggcaacagttttacctaaagcagttaaggtctggatgggcgccaacatcttgcagattgagtttgataatggggagtttcgatacatgcgtacacatttcattgatgactatgtttctgcgtggtcaccaaaaaagggtaaggggaagcggcgcaatttgtggttaatgccatcttgggaatggttgggtgccaatgctcggattgaaccggatggcactgtcgtgttgttcgaaaaggatgtttatacggcccaagaactttggcataatagtgtgacgcgaattgacttggtctctggcgtgcactgattcataaaagatgatgccaaataaaaatggacttggtcatttgactgagtccattttttgatgccgcttggagtatacgtggataacggcctaagtgagccatttagtgcgcgactctgatttatgaaaatcgagtgtgatttctgattggttaagccagtctgccattgtctattcgtgataatcttcgttataaataaagcgatgcagttttaggtattgtgcaccgagtttgcgttcattttcattatctttagggtaataataacgacgactagccaatcctttaggcatgtagttttgttgggcaatctgatgtggcatttggaatggattatcgatcagaccaccacctgtaatttcctcggagtgtttgtagtgcatatcgcgcaatccacggggcatggggtgctgacttggattttgtgtgtcctggtctagtttttcccaagattggtcaaacgaaccagacttgggtgaaatgcacatcagcatggtggcaaacattagtggatattttgctttgggcatgccaatcttttcggcttgattggcagcgaccacaatttgtgtgacctgttccgggttagctaagccgatataagtgtatggaatttcacgtagccggcggaccactgagggtaagtcatcattttttaacaaaatggttaagtagtagagcgccgcgtcagtatctgagccagccatcgaatccgaataagccgacagatagtcataatgcttagttgccttccggtcgtagctaaaatgctgttgctgggcaaagtgttgtaccgcagcaacagtgatttgcttctggtcaatagcgtggagcgtttccaagatatttaacgcaattcgcagatccccttcggccgaaatagcgatcaggttgagggctttagcatccacctgatcgtcggttaggttgtaaatgtcggttaccgcacggcgtaaagcaatctcgatatctgtatcgctcagtggttgaaactcaaaaatttgacagcgcgaacgaatggccggaacgattgacataatcggattttcggtcgttgagccaattagcatcacgtgcccattctctaagtagggcaacaaaaaatcctgcaatgttttagtcattcggtgaatttcgtcaattaatagaacaaacgattgctctgggtattgtgcgatggctttcgtcagctgtgccttattttcggtcgaagcattaaaagccacgaatggataatcgtcttgactcgcaataatctgcgccaaactagttttgccagttcccggcggcccccacagaatgaggggaatattaacatgttgatcaataatctggcgcaatggctggcctgccttcaacagatcctgttgcccgaccatctgttccagtgattgcgggcgcatttgatcagccagtggtgttttaaatgccaatttcaaagtcctttctgattaagtgttttagtcaaattgatgctatcatcatagcactaatattttggaaactgaaaaagaaagtttggcagttttagcggggaatgatgctaaaatgagcgagtctgatgccataggtttggcgttggttcgagtgatgggttgaaggcgtattgatttaagctttcatgcttgttgatgaatgagaaaggcgatattgtttcgtagatggtattgagtcagcttggggagattaataacttggaattacccccgtgtatacggaaaacagattaaacgaatcccggggagtgcaacatcagttgtaagcactaaaagacagaaaaggacagcgtatttggcgagttaaagttgaccaatattgcgcgaaccgtaatacgacgtcaactcattcccatccttcaataactaccttgccaatcatatgatgttgctcgataagttgatgggcctgccgcaagttaagcgcgttgattggccgtagtgtctgcgatagcgtgctttgaagcaagccacggtcaagtaaatccgcaatggtttctaagatatcgtgctgactaatcatgtcggccgtgtggtagtaggattttgagtacatccattcccaagcaaatgtcccgcgtttcttggttagttttttaaggtcgattggacgccgattttcggtaattgatgcgatgtggccaccgggtttaatgagcgtacatatctcattccagtgactgtcaagatcgcttaatccgaggatgtaatcgacatctttaatacctaaagcatgtacttcactaaccaaatcatgatgatgatcgacgactaaatcggcgccgtgttgctgcgtccaagcgatactttcaggtcgtgaagcactactaataactgtgagccccgctaattttgctaactgagtagcaattgaaccgacaccaccagcgccattgatgatgagaatggtttgattgcatttttcggaattaggtttagctgggtcaaaaggaatgtgaagttgttcaaataatgcctcgtatgcggtcagcgaagtaagtggcatggccgcacgggcagcggttgttaatgtcgcgggggcgtgaccgacaaggcgttcatcaaccaggtgataagcactgtcgcagccgggacgtctaaatgagccagcataaaagacgtggtcgccgggttgaaacagggtgacagcttctccaacagcggtcacaataccagtggcgtcccaaccgaggatcttgggtcgcatgcggtgctcatgccccgttttacgaacgccaacgtcaacaggattgacagcgacggcttgaacttgaacaagtaagtcatgaccttgagcgctaggttttgaaatcgtcacgtctcgtagactagcaggatcttcaataggtaagtggtcggtaaaaccaattgcatgcattattaatcaaacccctttcatgacattactataggttaccagtgaggaataaacaagacgtgaattatttgccacatagggacatatttgtcacgcctattagtccggtctgacggcaaagttgtgctacaatcaagacacttaattaaggtaggggaagttagatgcagcgacaagtatacgattgtacgccgggttgtccggttgaaagtaccttgcaagttattgccggcaagtggaagagcgtgattttgtatcatttatttacggcaggaacatgccggttcagcattttgcaaaaacgactgccgggttgttcgcggcggatgctagctcgccagttacaagaattggttcaagacggggtgattgcaaaacgagtttatccggtcgtgccaccgaaaacggagtattggatcacgccatttggtcagaccttgaaaccggtgattatggctatggagacgtggggccgacagtataattcagtgaatggaaaacctcgtcaataggaatgtgagaacgggcatagtgtgagtttcaaggaattgttgccggttttgttaggggcgattgtgcttggtgccttgctcgcattaatagtgactgtttaactaggctagtaaagaattgatgtgattctttactagcctagttgttttctaatctaataaaacgggagtctgacgtaaaaagtacaccgatagatcactgtttggcagcatttcttgaataatcatgggtttgcagtaagcaatgataccgtattaagtctgagatagattgtggattagttgcttgttaggaggtgcatgttagataattattaacaacttaatgaagtgcagcatggccgtgaatctcgttcgctaaatgggggtgccattatgaaaaattgctttggaatcattggtgggatgggaacaatggcgacggaggactttgtgcataccgtgaaccggctgaccgttacccatcgtgaccaggattatttaaactacgtcattttaaatgatgctgagataccagatcgcaccgcatatattttggatcataactgtgccaacccgttaccatcattggaagcggatgtgcagctacttaatcaattaggggtcatgtttattgtgatgacgtgtaacacagcacattacttcattcccgcattgacggcgctttctaacgtgccaattttgaatatgccggccttagcggtaacagcagcctgtcgatcacagcaaccgcgaccgttacgaatcggtattttagcgacaacgggaacactagagtcgcaactttatcaacaacttattcggtctaatggacatattcctgtgatacccaataagcagcagcaagctcaagtgatgaccttaatttatgacgacatcaagcaacgtgattttgtagatcgggtcaaattccatggcttaattgatcaattattgaatgctgctgattgtgacgccgtcattctcggctgcaccgaattgtcggtggctcaggatgctgcgccatatgattctgaacgaattattgacgcacagtatgaactagctcgagcaaccgtccaacgcgcacaggcaactaagccagcgttgatacttcgtcggcggccatcgattaggcggtaggagggtgcaggtaactggataaaaatgatttttgatctatttagtacgtgtgattgtagctgttataacaccactttcgtatacatgaagaatagtaaaattgtaagcgctcaaatcgttgctaactagcctattctcgcacatgcaaggttgggtccgtctccacacagtcccgcacaacacaaagcgagccttcaattgaaggctcgctttgtgttctcgattattcagtgtggtgcttccgaactgggctgacccaggtgccgctgccgtaacccaggatggttttaacggctggaatcagcgtagtgaccagagcgagggcgttaacctgccagtaaatcagcatgtagagtggcatgaaaatcagatatttaaacttgcggccacggtcgtcaacgatcaatgcggacaatagctgcaagatgccggcgaacatttcgaaggtcacgaagatgaaggccatgcagaacatatgatagacgcgctcgtaattgccagtaaagaagaaggtgacgagcgagatcaggaagatcagtgttgagacaaagaagaatagggaccagatgatgctcagcgtttgatcagtaataaaagcccattgcttcaaatacttaccgggatgactgacaacccgtttaaagttggtcaacagcacttcggtaccacctttggcccaacgtttgcgttgatgataaagggcgtctagattctcggggacgttcatgtagaatagaatgtctggcgagaaaacggtcgtccaaccattcaactggtgatcccaagcaatactgatatcttcggtcgcgcgatcttgccggaataagccgacgtcaatcagagcgtcacgacggtacattgtattggcaccactataggcatacatgttacctaaagcactgacttggctccgcttgataacaccaacgatacttgaaaattctacggtttgcgacttagcgatgatcgtgcttcggttctgaacgtccatgttggccgtgaccgctgccgtattggcgtgttcttcgcccatgaagtaactcatatatttccacagtgcatcgggttctggaatggaatcagcgtcattacttaaaatgaattcaccacgggcaaagccgacaccgacgttgaacgcgtgggccttaccctgatttttcttgattgttactacgcgtaggttgtcgtacacgctctggagacgttctaaaatagctggggtctcatcagtcgaaccatcgtctgtgaccagcacttcatatttttcataatttaaattgttcattaaatagttgattgtgtgttcaatcatgacttcttcgttatgcgctggaatcatgatcgtgataaagggttgttcttcaggcgttagcggttgaaattcaatatcgtctttgtggcgatggcggtaaatcagctggtagcagagtacaccgataaaccaggcaaatgcaccgagaattgggtaggagactaatagtaatagaacaaagttccagatactttcaaagggcttaagtgtttgcattatttccattggctagtcctcatacaatctgtggatttcgttaacatcgagattttgttcggggtcaaccgtgtagtgcttgacgtgttgccggaaagtggcctgcccgaatcgttgggtataaaagttatttagttgccgcttccgaatatctaactggtcttcgttgtattgccgttctttactgatatgctgcttgacccggtgattattgtgaatcgtggagacaatgaccacaatggcgattaagataaacgcaataataaagaaccggtcaaaaaagtagaacagcgtcttaccttcttcgtatttccaggcgtgaatgaactggggattattcgcaagtaacgttgacgagatagtccagtagacaggtacggcaacgcagatccaagtaataattgcgactagggtttgccaaagtttcgtccaccagtgccccttggaaaaatatttatcggtaacgtattgtttcataacatcttttttctccataaacgaacctccgagatgacatattgtttagtgatcgtgcggatcatatagtttatatcattactgatattgtcagtttatcgacatagaacaacaccagggtgcctaacattaactgcgatgaacagttttagaacaatctgaacatttaaccatgtcaataagcttacatgaggattgtattgatatgcaatcaatatacatatcagtatcatgatataagtaaaagccacgtatctttaattaatatacacttaatgggatactttgttaatctaatttgacaaaacggtcagtgcgccgattgaatgtcagattgtggtttagccattgcaaataaactggcgagaaaagggcaaccggcaaaacagcgctgaatttactggcgacttttagtgctattttcaatgtcttactcgggccccaacctatcaaataaatgcgggtgcgatcaacttagtcaaatttgatccaggtggtgtcatcaagttacgacaacttggaaggattttcgttgcttattttcaaaaaacaaattattatataatgatgactaaaatttagcacaattgcctagtgaaatccggctccagacctgatttagtccggtatttcaccaatagtatgataaaatgggctagtggggttatgccaataaccaaaaaatccagcgagaagcgaaggggataacgatgattaagcaatttaaaccaacttggatgataccagcaatctacaatgtgacaccggcgcagttacgagcgcagggcattaaggcggtatttaccgaccttgataacacgttgatcgcatgggacaatccggatggcaccccggaactgaaaaagtggctgcacgcgttacaagacgcgggcattccgttagtggtggtgtcgaacaattccgaagcgcgaattgctaaggcgctgcaaagcctggaactgccatttgtttcgcggtcactgaaaccactaccgctggggatcagtaaggcgcgtcatgacctgggcttacacaaaaatgaagtggtcatggttggcgatcagtatatcaccgacatgtgggcggcccatcttgcgggcgtgcccagtatcttagtacagccaatcgtgaagacggacgcgtggaatacccggataaaccgtttctttgaacgatttatcaaattacgattagcacatgtttatccagaaatgcattttcaggaggaccttaataagtgagtgaaacatcagaagaaactttatactgtattgggtgtggtgcggcgattcaaacgaccaatcctaaggcggccggctacacaccgaacagtgcgttacaaaaatcattagctagtgacgcacaggatttatactgtcaacgttgttttcggcttcggcactataacgaaatcgtgccggttggcttaacggatgatgattttcgtcatttgttagccacgattagagatgcgaacgcactggttgtgtacgttgtcgacatttttgatttgaatggaagcatcattcctggtctccagcgctttgttggggataatcccgttttgttagtcggtaataaggaagacgtgttgccacgtcagttacgccggacgaaattgcgggaatggatgaatcaacaagttcgtgcacagggaatcaaaccggttgacgttgcgttaacgagtgccaagaaggggcattccattgatgagctcttggcgatgattgaaaaatatcgtcgtggccgcgatgtttatgtcgtaggggtcacgaacgttggtaagtcaacgttgatcaatcggattattgccaataatactggtttgaaggacttgatcacgacatcccggttcccagggaccacgttagacaagattgaaattccgttggatgatggtcatatgatggttgatacacccggaattattcatcctgaacagatggcccacgtgttatcaggcgatgacctgaagttagtctcaccacaacgcgagattcgcccaaagggtttccaattaggcaacggtcaaactttgttcttaggtggggtggcacggttagatattgttgatacgttaaaagcaactgggacggtctacgttgataataacttgaccttgcaccgaacccggaccgagaatgcggacaacttttataccaagcatgtgggtgaactgattacccccccaactggcgatgctgtcgctgactttccaccattagttcgccacgaattcaaagtgacggaaatcagtgatattgtctttgaaggcctcggatgggtcacggtggctgcggatacgcgtgtagcggcctgggcaccaaagggtgttgcagtcttgacgcgcccagctatgatcaacaagcgttgatgagttgtggtcggagtagaatctgattcgcgattatcaaacagaaaattataggagtaaatcaaacttaatggaaaacttacgtggaaaacaaaaacactatttacgtggtgaagcccaccacatgcggccactatttgctgtcgggaaaaacggcttgactgacgaatggttgacccaactaacgggtgcgctggataagcgagaattaattaaagtcaacattttacaaaatgctgatgtgacaacggctgaagttaaagctgcaattgaacagaaaaccgcgattacggtcgttcaaacaattggccgggtgttagtcttatacttgccagctagtcatgaagaagaccagcattattcattggaagttgctaagttataggaggaatgacgggtgcagacggttaatcaaacagcgacaaaagttctgacggaaacggtgacggcaattccgcatcgccgtgttggtattttaggtggcacgtttaacccaccgcatttgggacatttgatcatggcccagcaagttggtgatcaactgggtttggatgaagttcgctttatgccggacgctcaaccaccgcatgtcgacgaaaagaagacgattgcggtggaagatcgtgcgaatatggtccaagaagccattgttgataatccactatttcggttggagacggcggaaatcgagcggggtggcaaaagctatacttacgaaacgatgaagtttttgaaagctaagcatccggacacgcagtactatttcatcattggcggcgacatggtcgattatttgcatacttggtatcacattgacgagctagttaaattagtcacctttgttggtatcaaacgaaccgggtacccaacgacgagtcaatatccggttatttgggtcgacgcaccgttgatcgatattagttccactcagattcgtcaaaaaatcagccatgggcattcggtccgttatctggttccggaagccgtggccgcttatattaaggagcatcatttgtatgagcaaaacgattgagtatactgaagcgattgttccatatcgtcacgaggagctaatggcaaaagttgccgcccagttgactgacaaacgctatcaacactgcttacgggtcgaggagactgcgcggcagttagctgctgacaacggtgttgatgtcgagttagctggaattgcggggttattacacgactacgccaagcaacgcgatgatcaaacatttattcagctcattaagacgcatggcatggaccccaacctggtttcgtatgggaacggggtctggcatggctatgttggcgctgaactgatcaaagatgagttgcacatctacaatgagccaattttgaatgcggtgcggttacacacggtcggtgcgccttatatgactaaactggaccaaatcatcttcatggccgattttattgaaccagcccgggacttccccggtgttgaagcggctcgtgaagcgacggccaagtcgttggctgacggtgttcgtttccagattcaacatacactagattatctgattcagaagggtgcgccagtctacccacaaacgttagcaacctataacgcgtgggtcggcggtgtggcccctcaatttgccaattaaatttaagggagagttttatggatagcaaggaacttttacaattaactgttgaggccgctgacgataagcgtgccgacgatatcgtggccttagacgtcgcggaagtcagtttgatggcggactattttgtcatcttatccgcggattccaagcgccaagttcaagcgattgctgataatatcgtggactttgtgcgcaaggccggttcggacgttaagagcgtcgaaggtcggactgcgggcgaatgggtcttgatcgatgccggtgacgtcatcgtgcacgtcttccaaaaggatgcgcgggcacactataatttggaaaaattatggtctgatgcgcccatcgtcgacgttgcacaatgggtaaacgcatgatttatcagacgtttgccgaactttatgacgaactttttgatccagccatgtaccagcaatggctggattttgtccgtcgtgagtatcctaaccaagatggtcagttgctcgaattagcttgtgggacgggacgcttaggggtgttgttagcccaagccggctatcaggtcaccggtttagatttgtcggagaacatgttagcactggcacagcgccatgcggacgaggcagccgtgaccttaccgctattacaaggggatatgctcgatttatctgaaattgggatctttgatgcggttacctgttttgctgattcgttctgctatttgcccgatattacgacagtccaacgtgcatttgaacaagtggctcaacatttgacagcggccggcgaatttttattcgacgtcattacaccttatcagacggatgaggtctatcctggttatatgtacaattatcgcgatgaggatcgggcttttatgtggacaagctatgccggtgaacagccgcacagtgctgagcacgatttaacgttctttatttataatgatgataagcaggccttcgacgaggtcagtgaattacatcaagaacaaacttatgtgttggctgattatcaacaagctctgcaggcagccggttttaatcatgtcacggtcagcgccgattttggccgccaacaaccggatgatcagaccacgcggtggttcttcaagtgtcgtaagtagtaggaggaacaagaatgcaagcagtcgggttaataactgaatacaatccgttgcataatgggcatcgctaccatttgcggcaagcacaacagttgaccaatgccgactgtgttgttgttgtgatgagtggtgattggctgcaacgcggtgaaccggccattttagacaagtggacacgtgcgaagctggctttggaaaatggggcggatctagtaattgaactgcccgtgttttttgcgacccaacctgcccatttatttgcacggggtggtattgaactactcagtgcactggactgtacgagtgttgtttttggtgcggaacatcctgagctagactttcaacggttggccacggcaattgcggcgcggcagggcagctttacccactataatgcgacttttgccactcagtttaacgcggccttgcaagctgccacgggcgtgacgttgacggcagccaatgatatgctgagcttctgttattacgctgccaatcaggccctggcacatccgatgcagttactgccgatcaaacgccgccaagcggatcacgcgacgacgacaattgcggccgatagtcgctacgccagtgggacagcggtgcgccaagcggcacttgcacaggattgggcggcgctgaaaccagttgtcccggccgacacgttcacggcactgactacgcaacgactgcagcgctggagcgacttttggccatttttacagtatcaattgctgaccgtcgacgttgcccgtagtggacagtatgatcagatggcggaaggcttggaataccggatgcaggcgatggcccaacacgccacgacttttgatgactttattcatcaggtcaagtcaaaacgctatacgtatacacgattgcagcgggtggcgacagccgcactactacaacttactcaggcagaagtccagaaggcacaggcacataattatctgcgcgtcttaggcttcacacctaaggggcaggcttatttgcatcaagtgaagaaacagctcccgttgccgctgtatacgaaaatcaatcaagacttacgccagcatgctctgaatctcgattatcgggcggggcgcgtctatcaattaattaatgggcaatcgcaggatttatatcggcagccatggcggttaccggtaacaattggttgaccacggcgggctttcttgatatggttaggtctaatgacgggcattttggactgtcaaggaaaaaacattgacaaaggatttttacacaggtataatttatcacgttgcattaggaggtttttaaatgaaatggtcactttcacagcttaaaacataccgtgaaacgccacttcagtttgatgaagcattggatttaaaacactccttgatgagccgttatccagaaattatcgatgttaagtcagttcacgcaactggattagcgagttatgataaggataatgtgttaatcacggcgaagattgacgcaatgttaacattgccgtctagtcgctcgctgacgccagtggatgtcccattggcttttcaaatgacggaatattatgttcctcagggaaccgatctgagtcgttttgacgaagaaactgatacggtaattattttacctgaagatgatattttagattttgatgtcgctgtggaggataatattttaattcacatccccatgcagattctttctgaagctgaacaagacggcgccccgatgccaactggtaagggctgggaagttctctccgaggacgaccaagcgttgcaagctgcagaacttaaaactgttgatccgcgtttagctaagttaaaaaacctgttccctgatcaggaagacaaggattaagttagctaggcgtatcaaaacacacattatgtgaattcacttgaaggaggtgtaggttgatggctgtaccagcaagaagaacatctaagatgcgtaaacgcaaccgtcgtggtcatattaaattggctacaccaaatttggcaccatgcccaaattgtggcgaattacgtgtatcacaccgtgtttgcccaagttgtggatactacaacggcaagcaagtcgtaaaagtaaacaactaattgttagttggtgaaaagttgcattgcggccatggcgcatggaacttttcgttaccataatacgatcaaaaagcccgcttaggtgggctttttttgttgtcttcaattaagtttgagtcgggaccagcacttcttaaaataaggtttgactgagctgccagcgcggtcaagcgagtggctttgcatattgattgcgatgaggcgtctcccttccgtatactaagactatcaaatatgggtacggcttcataataagtgttactgacgcagcgacaagggggttatggagatgatgagcaaaaaatatgggatcgggttagcactactcaccgtggttctgttagctggatgtggcacccgacagtcgacgcaaaataaggcgacaagccaatcaactagcagccaaagtaattcgaccaaaagtgtgacagccaaaacgaaagtgtcattagccgcagccatcaaaaagtttcagcaacaatatccggacgccagtgtgacgagtattgagttagaagaccaactcggtcgaccggtttacacgctggaaggcgttggcggcacccaggaacatgaattacaactcaatgggcgaaccgggaaggtcatcagtaagcagtctgagatgctggatcaagatgatcaagctgacgctgagggtgaccggctgaatcttaacaaggtaatcagtcctagtaaagcggtggcgattgccatccatgatcgtaacggtggctatgctagcgaactcaagctcgataaggacaatggcaccacttactgggaggtccaggtacatcaaggaaagcagcaagtcgatattaagattgatgcctatgaaggtcatattttggaaactgagcacgacgattagtaccacgtggttgctggtgaaaaggggcggtaagtagcttcattttgtcagcaactagtcttgaaatggtcagccggctaaacgtatcgcctattttgtaaatcactgatttgatcaatagctagtcgtaatcatcacgtccgtttccatcacaccgaattcttgccacatgatttgattgatggtttcaatcagacgtgtgatttcaatcgccgtcatccgaggtggcacaacgatcgtggctcgcagcatgatgagattaccatcataatgagccttgagaaaaatgactttgcggacactagttaaatcagcaattcgccgttgatagcgatcttcaaggtaagggtcgaaatagtcaactaggttcagactactttctcgaaaaattttggtgccagtattgaggatgtatagccctaagccgatactaatcaggttatcgaaccactgaaggtggagcttgaccgtgacaagaatcgtaagaacggtagtcagactggtcaacgcgtccgtgaaggtatcacggctcgctgcggtcagggcagcattgttaagtttgcgactccaataatgattgaaggcccataagaccagtagcaccacgaaggaaaacccggcggccaagccggcgatactgctgaggtttttgaagggggtacgggtggcgaatgtcattacgcctttgataataatgtcgattccaatggcagccatgatggtgtcggctagtaaattaaaaatcgtctcaaaacgaaagcgggattgctggattcggggtcctaattgctgctgctccgcgggtgcgatgggtgcgccaaataaatcgtcatcgtgcgtgcgactggcgatgaatagaccagtcatgagtagcccggtcgaaaaaatttcagataaattattaaaggcatccgcacgcagggcctgtgagtggccccagcgtgcccctagaagcttgataataaataggcccaaataaacggccacgttgccccagagatggtgacgggccgttttaagcgaaatgacaacgggctgttcaatttgatgccaatctggcagtcgttggatcgacatgattaggggcctccttacgcatcttgaattggactgctggtcaggattagtggtgctagggtgtctctctggtaaaagtggccaccagcgggcatgtacgaataaaaaaagtgcggaacgtcagaataacaatgaggacactagcctaaacaccacgaaccgatctatgaaggttatccgtttattttactgtaagcctagcacggtgtttttaactttgtcagttggtgctgtttgaaaggtaagtaacctttttggatggtcctatgaaaattaatttctttccaagataaattatatgaaattaattttaaaatttgcggtcatttactttattaacagcgtgttttttggtacgatagttgcgtattaaaaattgggaggcaataaactaatgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacgacggattatcatgatggttaaggctggtaagccaaccgatgccgttatcgatgaattattaccactattagataaaggcgatgtcttgattgatggtgggaacaccaactttaatgacacgatggcgcgtaacgcccgcttagacaaatccggaatcaactttattggtatgggtgtttccggtggtgaattaggtgccttacaaggcccttcattgatgcttggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaagggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaacgttcaagtgccacaatccgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagcaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgccgacatcgccgccaagtatcaacaatcaacacgtgaagtgcttagcttagcgatccaagctggtgtaccggtaccatcatttagtgcggcattgtcatactacgactcataccgggccgaagtgctacctgctaacttgttgcaagcgcaacgggactactttggtgcgcatacgtatgaacggactgaccgtgaagggttataccattacagttggtacgaagaacaataaaatcattttgaatgaactaaactgtggctaatgacgttacgcgtgattaggcgcagtttttttgtgctgtgggtggctgtgcggtaatgatcgttggtttgagtggattagaacgtacgtttgcgttaaaattgagagtaatgaataaacgcgaaagtgggggtcgccatgcgacaagaatcattatttaacccggataaatctagtagtagtccgttggcttaccgggtccggccagtgacgctggcggatttcaagggccaagagcatctacttggcccgggtaaactattacgacaattaatcgcagaagatcagttaccatccctgattttttggggaccaccgggagtcggtaagaccacgctggccgaaattattgcgcaacagacccagtcgcactttattacgtttagcgcggtgacgagtggcattaaagaaattcggcaaatcatggatgaagcggaggctaatcgagattttggtgaaaagaccattgtttttatcgatgaaattcaccggtttaataaggcccaacaagatgcctttttgccgtatgttgagcgcggcagtatcacgttaattggtgcgacgacggaaaatccctcatttgaaattaacgcggccctattatcacggtgcaaagtattggttttaaaggcattgacgcctgatgcgttagaagctgtcttgcagggcgctttgcagaatccgaaggggtttccggatcttgagattacgatgcagcctgatacactaagattgatcgcagaatttgctaatggtgatgctcgtatggcgctcaatacgttagaaatggctgttttgaacggtgaccgcgatggcaagcacgttacgattactacggccgggttatcgcaactgatcaatactaagtcgttgcgctacgataagcatggcgaggagcattataatattatctccgcgttacataaatcaatgcgtaatagtgatgttgacgcggcgatttactggttgatgcggatgctagccggtggtgaagatccgctgtatatcgctcggcgtttgattcggtttgcgagtgaggacattgggctagctgaccggcaggcattgccactgacggtagcagtctttcaggcgtgccagttgatcggtatgcctgagtgtgacgtgaatttgacggaagcagtgacttatttagccttagcaccgaagtccaatgcattatacgcggctaaatcggcagcgcaagcagatatcaaagcgacgggtaatttaccggtccccttacagattcgcaacgcaccgacaaaattaatgaaagatttaggttatggttctgattacaaatatgcccatgatacagcggccaaattaaccacgatgacgacgatgccacctgagttaaaacagcaccggtactatgagccgactagccagggacaggagaaagcctggcaacagcgcctagctgctattcgccagtggcaccagcaacatccgcaaaccgaaccgtcagatgatgagacataaagattgcaatttaatgagaattcactaaaattagatttgggtgaggagcagaccctggttggggtgtaggaaattcagcgttttcatgttaaaataacatgttgtactagcttaatgcaggttagtggtgataaatcactgattcgtacggtttttagataagttgaatattaggagtgactaaaagtaaatgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccagaactgaacggtttggaagtctgccggcgggttcgtgaagtcaagaacacgccgatcattatgatgacggcccgtgactccgtgattgatcgagtttccggcctggatcatggggcagatgattacattgttaagccatttgctatcgaagaattacttgcccgcttacgagcactattgcggcgaatcgatttggaaagtgaacaacaaagcactaaacaaacgaccgtcacttataaagacttgacgattgaaaaggaaaacttagtcgttaaacgtggcgacgaagtcatcaacttgacgaagcgtgaatatgaactgttattaactttaatggaaaatattaacgttgtcctcgctcgtgatgtcttactaaacaaagtatggggttacgaatcagaagttgaaacgaatgtcgtcgacgtttatattcgttacttacggaacaagattgaccgaccaggagaaaagagttacatccaaactgttcgtgggactggatacgtgattcgttcttaatgactgacgctgatacgaatcaagtgacgcctaaaccacggcgccgttggtcattaaaatggaaatgggcgctcgggaccgcaattgggtccgcgctcatttttatttgtttttcattattggtctataagagtttcacgaacctcttattgcaccaagaacaacggaacgtggctagtgctgttacaacggtgcaacaatcgttacgaacggagtcgaagggactgaccattaagtcggtggccgctaaattgcaacctgaggcgagcgttgaaccggcaactaccatgagcgaacgtaagcatggtgtgctgcaaagtaaaatcttttcagattccgatttaacagccttatcccgtacaaatttagctgtgacggtttatgatccacacgggaacacactctatctatcccgcaaggatgcacatgagttctctaagaataagacgcgtcaagtggtggtgattggccgaggaagtgatgctaaattagttgggcgggcgcccatttatgcggctagcaatcaccgtttgatcggttacacccaggtcactgataatttggcggaataccattcaacgactcagaatttgatctggatctttattgtaatgacaatgatcactatttttggtgccacgctactgggctacttcttagctgcgtttctattacggccaatgcgtaaaatcaaacagacgattaatgcggtcaatgatgatccgcaaactgactcgcgagtgcccgatcttaaacgcaatgatgaattgtcggatttagcagtcgtattcaataatatgcttgatcagatgcaacgctatattaatcaacagcagcaatttgttgaagacgtttcccatgaattacggaccccggtggcaattatccagggccatatggagttgctgaatcgatggggcaaggatgatccacaagtgttgtcggaatcattggcggctagtttgtcagaaaccaagcgaatgcagagcttagttcaagaaatgttggacttatcgcgtgctgaacaattggaaatcaattttagccatgagacgtcggacgttcagaagttagtgacgcaagcatttaacgattttacgatgattcatcccgactttcattttacgtttgatgatgatgttaaaaagccggtgtatgctcagatttaccgtaatcacctcgagcaaattctgattattttattggataatgcggtcaagtactcgacacgacgtaaagaaatccatttatcattatccacggattatcgctacattgaagtcgccgtccaagactttggtgagggtatttctaaggacaatctcgatcgggttttcaaccgtttctatcgggttgataaggcgcgtagccgtgataagggtggtaacgggttaggattatccattgcgcaacggttagttgaaggttaccatggtcatattagtgttgaatctgtggtgggccaaggctcgatctttcggttccagttaccgattctacgggacgcgaagctcttagctaaggccgaggctgaaacgaatgatgttgaaaagattgccaagtcggaactgccagccggaatccgaccagctactcgtgatgaagatgaagcgcccttggatgatcatgagcacgaccactaggtaatcgaattattgatgaatttaaaacgcacattcaagttaatttaacttgaatgtgcgttttcagtttggataattgcgctgtaatgaattttaaagccgcggcctatgggatcatatcgtgattttgagggaggcttgaatcaatattgagcatcgactgacagttcgatagggcgcagtaagatgctgattaaacgacgaataggttgtacaccagcaggttgggtttaatcctgattcagattgatccgactcgaaatatatttaagctgaccgatatttgttggtatgttcatcatgaaaccattttcacaagtaaccttttttggtatagtggaagagtagttaatttaatcagggggcgaagttgttgacgaacgaaccaacttatcggccaatgacgttcaaaatttttttggaattcattcggctaaatgccaaggcagctagtgtggtgccgtattttattggtattttattttcaatctattattttcatgcgtttaattggatcaattcgttaatttacttagttgcacaagtagcgattgcattgtttgtgacggggtttaataacgtgcaggattactacttggctaaggatttacattatcgggatacttataacattgttggccgtgagcacctatcaccacgacgatcattgaatttgatgctagcgatgttagcaactgcaattattttaggattagtgctagtcgtcagaacaaacctattgttactgttcatgggcgctgcagcgattggtgtggctatcttctatacctatggcccggtaccgttttcgcgcttcccgttgggtgaattactgtcgggatgtgtcgaaggatttggcgttttctttctgagtgtttatatgaacgtcgcgacccccgtactggcgggctttaagtttgcttggccgcagtttgcgattgtggggaatttagagaacatattggtcatgattttggtggggctaccagggattttcttggttgcgaatatcatgttagctgataatatttcagatttacaacaggatattcgcaatgaacgttatacggttccgtactatattggtcatcgttggtcactacgggtctacgatacgctggcgctgttaggttatttgccagtgctgatgagtgttgttttacaaatactaccgatttatcagctggcagtgttgctcgttttaccaaaaattttgaagaatattcgggcctttaacgcggtgcaggtgaaagaaaccacctttaatacggcaccacaaaatttgatgatgtttcaaggcatgcaattacttggactgatcctgggtattttcttttaatccggtctgattaattgggatggttcacaaaaacagcggccgtcatccagcataattgctgaatgacggccgccgttttttgtgtcgctgttttttggaccttgttagtcatgtactgcggttgttttcggcggctatttactgatcaaccgcacggtactgcggccatcccccatctttttgatgagaacttgttggccaatcgttcgtttcattgattcaatgtgactgataacaccgaccattcggttttcaccaattgtttcgagtgcctgcatcgctttttccaaagtttcatcatccagggagccgaagccttcgtcgacaaatagtgcgtcgatttggacgccattagccgaagattgaacgacctcactgagcgagagtgcaatcgacagagcagcaatgaaggtttcaccaccagacaacgtgttggatgaacgcgagttgccggtctcattatcgtaaacattgatatcgaggccatggtcactgcggttatcactcgcttcggcagctagttcaaatgtgtagcggttattggaaagcaggttgataaagtgatcattggcgtagtttaagacgcgttgcaagtagttttggacaacgtaggtctctaacttgagcttgtgatcgttgccatctttaccagtcatgatattatacaggcttgtaatttcggcgaaccgctttgcaaatgtgccttgctggtgcatgatttgttggactttttcgagacaactttgcgcgtcggttaaggcttgttccgccacggtttgggattgcagtgctcgatccttatgagcttgcaggtcggccagctgagcttggatgcccgtaatattcggtcgttcaacgttcgttaaggcggtttgcagttgcttgatttcggttgtcagacgctccttgtcttgccgataggtggcaatttggacttgcagggcggtcagtcgaccattggcgagttcttctaaccaattttcaagtacggtttggtcatgagtcggtgcttctggagcagctaaggcctgtgcgattgtttgctcaagctgcgtgcgcgtggcctgtgttgccttcaaccggtcgtttaaatcatcgagcttagtttgatgttttgataaagtaagttgactggtttgaacggtggcttgggcggcctctaggcgttgttggtaggtcgcgacgatctgattgagatgcgctttttcggccagcaggtcagcgcttgtgacttgtaagtccgtaccaatggctgcctgagctaccgtcaaatcggctgttttattgcgcaataaggcccgttgttcgcctaactgtaactccgtttgttgggcctgtttttgttgtgcttccagttcagcagtatatttctcaatagcttgaaccactcgttgggctgcctcaagcttcttcgtaattgtggcgagttgctcagcgaaaaaagccctgactgcggtcaaatcgtagggtgactttagtgctagtccgttggtttcaatcaactgttggtaagttgaagttagttgcgtttgggcggtggttacttgctgcgtagcctggtcaacttctttttcagcctgttcgacacgttgttgagttgcttccacttgcttgttggctgccgccagcgcgttttgagcgtcgtcaacggcttgcatggattgtcgtaagtcagcttcatttgcaacgatggttgtgaccggcatctgtgaatgatcggttgatccacagaccacgcagggctggccgtcaacgagttcttgttgtaattgggcaatcattaagctttggcgttgaccacgttgttgttcaaattggacttgcgcattgtgctgattctgttcatcgctggcaagctgcgcccgtaaatcagtcagttgcttggtgacgcgctgctgttcttgttgcgcacctcgccattgactatcaagtggtgtcagggtgtcgacgaactgttctcgttgtttaatcagcaaatctttagtggcgtgtaagtcatcaatagatggcaagttcgcttgttgggtggtgattttggctgttaatgtctttattacggtttggtgctgttcaaaagtcgccttcagatcagcgacactcggcttgagctttgcgagctgtgcgatgagactttcaacgcgttgcgcttgtggaatcaacgtggccaattgttccaagcgctgctggtgctgatggttagcttcactttggtcatgtaattgttgaactgcagcttgcgcttggcgatagtcgtcctgcgcttgttgcacgttatccatagctgcttgctggtcaagtgtcaattgcttttggtcacgtgtttgttgagtgagggcttgcatggtggcttgtaggggctgggcccaagttaacgcgtgcaactgttgcttggctatggtaattgccggtgtttgttcttcaactttagtttgataatcagcttgcgcctgtgtgagccggtcaaattgttgttggcgatcgcgtgcttgctggtaggtcgtttcggccgctttaacagaccgattgattttactagtcgtttgctgtgcttggtcaaaagcactttgacgcgtcgtaacaaatgctcgtagtagtggaattttttggttgtccggaactgcttgaagttgagcctgttcctcatcattccaagttgctgaggctagtgcgacccgcaaatcggcgacaaactgatcaccagtcttgctggcggtttgatactccgctttaagttccgcagtaaagtctgaataaagttgcgttccaaaaatctttttaagaattttttccttgtcagtcgtttttgactttaagaattccgaaaagtcattttgggggagtagaatgatttttttaaattgatcggcagtcaaattcaagatggtcgtgatctcgggaccaacgtcggccggtttggttgcaatgctctcaatctccacgccaccaacgtgatcaacgacagctaatttggccgtactattctttttcgtcagtccagatccttttttcttagctaagtattgttcaggggagcgcgcaatcttatagagttgattgccttgctcaaagtagaaggtgacgcttgtcggttggtcagcgggggcgaactgactgcgcatctctttggctgcccgaccatccgtcctatcattcgtcgtactgccaaagagggcaaaagtcatggcatcgaaaatagttgatttaccggccccagtatcaccactaatcagaaaaatcggggtactttctagcttgctaaaatcaataattgaatgttcgtgggggccaaaatagttcatggctaaataaacgggtttcacggctaatcctcttttcttaagttgacgaaaatctggtcaacgagttgttgttgtgtcgttgagagctggttaccagtaatcgcgtggaaaaattgcccaacaattgcatcaggactcagttcgttcatgttttttgggccactaatggcggtggcttggtggttcgattcgtagtccagttcgacaattgtgccgtagatttgttcgagttgcgcccggacgttcagatgcttactacggtcgaattcctggacggtgatcgcaaaccaagcctgctttaacggctgttgctgataaaagttgggatcaagtaacgtttcccaaggcgcacgcaacgtaaccaagtcagtttgcggctgaattggcttgaattcatgggtgatcgcagtgggtgtgattgtcacaatttcaacacctttgccatggaacttagggttggcttccttgacgttaaatttgacggggctaccggcataacgaattcgatctttgtcgggtgaggctaaccgagtgtgaatgtggcccagcatcacgtagtcgaagtctgcgaataaatcggtggtcagcgttgccaaaccgcccactttggaagttgtttcacttgttaattccaagtcgtcatctgctttgggtgtaacggtaaaatgagtaatcaacaagtgccgtttttcaggatcaaaggtggcaacgaggtcactaaccacgcgttgcatcgcatcgtgaatggtgtgaatcgccttgacttgtttttcgggcaaaccttgttgctgatagtagacccgcgcgtcaatggggtcaaaaaacggtaacataaagatttgtgccgttggggtctcgatgggcgtgaaggcctcggctagtaacgtattgatatgaaaattattataggctagccattcacgaccgtagttgagacgtttggcgccatcatggttgccagcaatggcatagattggtaggtgatgctcgatattaatagcctgcagcatgtggtcaagtgaagtgaccgcatcggtactcggaacggcccggtcgtagatgtccccagcaatcacgataccatcaactttttcagccaatgcaatcgttagaatttgcttgaacgctgcttcctgttcatctaacaaagaataaccgttaagcgtccggccgatgtgccaatccgctgtatgtagtaacttcatgggagttcctccttgagtttgaattgttaatttccattatcgcatatttacataaaatttcaggtctcgaagtgtcgtctgcccaaagtagattaattttgacgaaatacgtttgatttagtttggaatgttggcggacaaacttgaaagtgggcaagttctaccccttattatgcaattcagctataattgcgcttaactagttgagcaattattgattgcaacatacgggtgagtaatttgctggtcatccttgctttcagcgattgcgtgttttagtcacgcataacgtcggactcggtattggaataattatggcgctgcaaccttatctggctagcagtttagaatgggggcttactcatgattccagaaaaatggcaacagacgcttggggttaaattgcttatcatggtaaatttaatcaatttggtcatcttagtagtgattaaactggccagtggtgggcccatgtggcaaattcgtaatgcaccgttggccgtggttggtgggttatttttaattgggattagtttaattttgatctgtaaacagaattccaactggcgcaagggaacgtatctcggtgctgatattaacttgaccgttttattttatttgttacttattgatttcaaccggatttccacgattggctttgcgctgatcgcgataatcatctcgattgtcgcattaccgatggcatatacttctcgtaatcgcttggttggaatccggattccgtggacctatttgtcagaagaaaactggcatcggactaatgtgctagcaggcagattatttggaatctcaggaccgctgttagtagcgatgggaaagatgtcaacagactcatttctcaatgtctttgttacgattatcgtgttggtcgtgattttgaccgtgggttattcctaccagctaagtaagaaattgatctgatcggcctggcagcgttaattggcatctcgtggtaatgtttgtgaaatcagttaaggggacggctgcgtgccggttaggtgcaacgtaaaaagcaccgccatgagaattttcatgacggtgctttagtgttgattaagcttcagtggttatttacggtgtcgttgttgtttaccggcattccgaccacgccccgcattattttgcggacgaggatgactaggcttggattcagttgcattaatcggctttggttgcgtcggtgttggtgttttgatggggtgctttttgagttctgcttcaacttcacgccgaatacgtggccggaagaagttgatgatcagtgtttgcaagcaggcaaacaaaccaccaacgaagaagtaaagtcctaaacctgcgggagcggacatggaaacaaataaaatcatgaccggactcataatgagcatgagacgcatcgtcttcttctgttcttcaggtaaaccaatcatggataggtaaccctgtgccaagtaggataaaaaggctaaaatggctagaatcagactggatttcccaagggagatccccataaaggtcgccttagataattcaggcgaatagcgaatagcgtagtacaaggcggagaaaattggcagttgaatcagtagtggtaaacagccaataccaccagtcatgctaataccgttgtcacggtaaagttgcatgagctcattactgattgcggctttttcttcctgagtcgtcgctgctttttgccgtgcctggattttttccatctgtggccgaaccgcggacattttttcttgttggtaggttgatttacgttgttgattaatcatcattggcagtaaaacgagtcgcacaatgaccgtcaagccgatgattgcccaaccgtagttgttaccgaatagttgtgacaaccattccatcacgttttgccctggctttgcaaggtactcgtaaacaaacccgtatggtttaccagctttggtcgtttgcacacaaccgcttagaaacagtgctaacgttcctaaggtgatggtgagcgtaaggcctttttttgatttcactagttaataatcccctttgttaaagtcatataatgatgatgatactaaagatgtcgggggaattcaattggttatccgaaaatcgtgatagttttgtggttcaacttcatgcacttcgaggtgcttgaccttgccaaaatcggttggcgactgccgaacaacgtcgataaagacttgcactcgttgatcttcaccctcggcttcaataaagactgagccgtccatcaggttacgaacgattccgttcacgccgcatttgtcagcggcaactttagtggcccaacggaagcccaccccctggacccggccgattgcttttaatgttactgcacgcattgtgtcacttccttacttaacttgttcagctagtctaacctgtgactagcatcttgattgtactgattgctgattgtattgtgttagcataattagtacaatctgtattacttatataatagcatggaaatgttcaacgggcgatatgctatacttgggataaaacggacactttcgaatgatacagggtgccccgaattgacaagaccggctgatgtttcaaccgattaattaaaggaagttgacgatggaaaaaattaattcattacaaaatgcgcacgtcaaggcgtggaaaaagctccaaacaaagaagggacgcaaacaacagggacaatacttgctagatggttggcatttagtcaacgaagcagttaaagcacacgtcgcgattcagaccttgctcattactgccaagcaactggcgaccgaaccggacttgactcattttccagcggtcattgaaatctctgatgaagtcgccaaacatatcagtgcgacggtgacgccgcagggggtgtttgcgctggcgaccctgcctgctgcaattgaagatctatcacaattagatttaacgcggccttggttactgctcgataatgttcaagatcccggaaatattggaaccatggtacggactgcggatgctgcgggttttgccggcgtcgctttcggtaccgggacggtggacatccatcaacccaaagttgaacgagctatgcaggggagtcagtttcatttacaactgattagtactgatctcgacaagttggttgaccaattgcaggcgcagggttcaccagtctacggttcagagttaaatccacaggcagcccggtatttagatattgacgcgccggctagttttggcttgatcatgggaaacgaaggtaatggaatgagtcgggaattattggcacggacagaccaaaacttatacattcccatcaaggggcaagcagaatcgttaaatgtagccgtggctgctggcgttttaatgttcggtttatatcgctaacttacaattagtaagaaaatgctaaaatccaggtaaaatactttcaaaatgactgactttttagtagaatagccgtagatattagcaaagggagctttagatgaaaactaataatgcgtggcaacaagattctgaatacgtggcgatcgtcgaagatttattagcacagccggccgttcagcggcttgctgagtttacacagcaccaccattcaaatcgattggatcattcgattgcagtttcatatgatagttatgttttagcgaagaaatggcatctaaatacgacggcagtggcgcgtggtggattattgcatgatttgttttattatgactggcgtgaaaccaagtttgatctcggctcgcacgcatttattcatccgcgggtagcgttacgtaacgctgaaaagttaacgaaattaacgccgatggaaaaagatatcattttgaagcatatgtttggtgcaactttagctgtgcctaaatatcgtgaaagtttgctcgtctctttagttgatgattatgaagcagaacatgaattttttggaccattacgtatgaaagtggccaaacaactagatcggttccgaggcaaggtctccgccggttaattcaataattgggggtcattgcatgtcagaaatgctagctgacacggtaacagaatccaacgtggatttcgaactgtgtccaaaatttgaaaagacgttctcaattctagggaaaaagtggaacggtttaattatcgatgttttactggaagacggtccccaacgctttaagaatctggcacgccggattcctaagtgcagtgatcgggtgctggtcgttcgtctcaaggaattggaagaaaacggcattgtgagtcgggtaacccattgtgactctgccctgattgagtatcgcttgactacgaaggggcaagatttacgacaggtcatggatacggtccataactggtctgataagtggttcagcccggccgaatcctaatacggggttgacgtgcagggcactttgccataaactgacaatgtagataaaagccttgacgagaaatagtagttagttacggcgtcgtagggacgggtgtcaccgattgaaagcaccctggcgaccaagattgacgaattcactctctgagctgaaattgggcgtttgtgtaaacaaataattttccggtatcccgaccgttatgacgggtagtgagtgtgcatagtgactactatgcaaacaagggtggtaccgcgatgacctcgtcccttttcagggatggggtctttttttgtccgcaacgcaactaaaaattggaggcagcatatgagtttacaagatcgattaaccgaattacgcgatcaaggcttggccgatattaaatccgccgatgttttgaaaaaggttaaccaagtcaaagttgatttgcttggtaaaaaggggccgattacagaagtattgcgcgggatgcgcgacttaagtccggaagaacggccaaaggtgggcgcttatgccaacgaagttcgtgaccggattcaggctgcgattgatgaacgccgtgaagaattggaacaagcagccgtcaataagcaattggctgccgagaaactggacgtgacgttaccgggtcgggaagtcccacaaggtcagcctcacgtgattacccagattattactgaattggaagatctatttatgggaatgggctatcaaattgttgatggtgatgaagttgaagaagattactacaactttgaacggttgaacttaccgaaggaccatcccgcccgtgacatgcaagacacgttttatattaccaaagacgtgctactacgcacgcagacgtctgctgatcagccgtggtcacttgaaaatcacgatttttctaaaggaccgctgaaggtcttgtcacctggccgcgtttatcggcgtgatacggatgatgcaacccattcacatcaatttcatcaaattgaagggttagtcgtggacaagcatattacgatggctgatttgaagggcaccttaattctggttgccaagactttgtttggcgatcaattcgatgttcggctacggccaagcttctttccattcacggaaccatccgtagaagctgatgtaacttgctttaattgcaatggcaagggctgtgcaatctgtaagcaaacgggttggatcgaagtactgggtgccggcatggttcacccccacgtgttagaaatgtctggcattgatccagaagaatatggtggttttgcctttgggttaggaccagaccgctttgcaatgttgaaatacggtgttgacgatatccgcaacttctacttgaatgacgtgcggttcttgtcacagttctataagaaaggttaggcgtccacatgagaatttctacgacatggttacgcgattatttgaagctggacattccggccgatgaattagcagaaaagattgaacggacggccgttgaagttgacggtgttattcgtcccagtgaaggattgaaaaaagttgtagtggggcacgtcttaacgtgtgaaccacatccagattcagatcatctccacgtttgtcaagtggacgtaggcgaatcagaacccttgcaaatcgtttgtggggcacctaacgttgcggctggcgaaaaggtgatcgtggcgttacccaattcatggattggtggtcacactaagatcaagaagagtaagatgcggggagttccatcaaatgggatgctgtgcgccttagacgaacttggttttgatgaaaagttagttcccaaagaagttgcggatggtattttcattctgcctgacgatgccacgccaggtgatccggtcttttcatacctagggatggatgatgaaattattgacatgtccgttacccctaaccgtggtgacatgcttagtatgaatggtacggcgcatgaacttgctgccatttacgaccagcaaccaacgatgccgaaagttgatttgcatgaggatgctacgacggtggctgcggatgatctacatgtggctgtcgctgccgacgaacatgatgtcccaatgtacaaaatgcgtctaattaaaaacgttacgattaaaccaagtccgttatggctccaaattcgaatttggaatgctggtatgcggccaatcaataacgtcgttgacgcaacgaactacattttgatgcaatatggacaaccgctacatgcttttgattttgatcaattgaatgacggtcaaattaacgtccggttggcgaaagctggcgagcatttaacgacgttagatggtgaagatcgcaaattactagcgagtgatctgttgatttgtagtggcgatcaaccaatttgtttggctgggacgatgggtggattagcgaccgaagtcactgatcagactacgaccattgcgttggaaggtgcggtttttgatgcagttaagattcgtaaaactgcccataatcatgacttacacagcgaagcttcaatgcgctacgaacggggcattgaccacggcatgactgcaacggccttagacgctgccgcagccatgattgcagaacttggtgatggtcaagttgctagtggtatggtcatcggtcgtgatgaggatgtgcaaccaacgacagtaaccattgacttagcacggatcaaccacgtcttaggaactgagttgtcattggacacggtcagtgatatttttaaacgattggactttccaacggtcgttgctaatgaaacgttcacggttacggtgccatcacggcgttgggatatccatattccggctgaccttatcgaagaaatcgcccggctatacggttatgataacttaccagcgaccctaccaacgggccaaccaacaatcggtaagcttaatgagacccaacaggtgattcgtgactcacgtaagttaatggaaagtgctggcctcacgcaagccatcagttactcattgaccacggagactaaggcgaaggcctttgcgcttcatgctagtgacgtcactaaattagactttccaatgagttcagaacggaccacgctacgcttgagtctagtttctggtttgctggatgatttagcttataacaatgctcgtaaggaacataatgtggcattgtatgaagaaggacgggtcttttacagtcaacctgaacaagtccggccgaaggaaattgaacacattgccggagctattacgggttccatggttcccaagagctggggcgttgccgaacaacccgttgatttcttccagattaagggtatcgtggctggttatctgaagagtctggcgttgcaagatgccgttagttacgttgccacggccgaacatccagagatgcatcctggtcggacagctgatatttacgttggtgaccagttagtcggtttcgtcggtgaagttcatccaacgactgccaaagcctacaagattcgggaaacttatgtctttgaactggatttaacggcgttgattgccttaccaaaagcgcgtcaacagtatcaaccgatttccaagttcccaagtatcacccgggacgtggcgatgttgattgatgacgatgtgaccaacgcaaccgtggttgccttgatcaacaagaagggcggcgcgcatttacggcacgttcaactctttgatgtttataatgggagtcacgtgccagcgggtaaaaagtcgctagcttatacattaacgtatcaagaccagaacgcaacgttagtcgatgatgatgttacgacagcatttgaaaaagtactgacagccttaacggatgaattaggtgctgaaattcgttagtttgttgatagtcttgctaaacgccgaatgatttgaagtcattcggcgtttaatgtgtgtccaagatcctaaaaaaccataaaactaatggcgaactagtgcaaactgggcaacagttttgtataattgataagattaatcaataaatggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaattgcgaaggtcttgaataaaggtggttcatcggaaccggttcagagttctagtggtaaagtcctaatcgttgaaggtagtaagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataagaatgaggcgtaacttaaatgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccgattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataaaaaataacgtcttaaccagcgctattttagatttaagagtttacttttaaaatctgaaatggtaggctggtttttgataactatattgcgtatttgaggagtgaaacacattggctgaagataagacatatccaatgacagaagaaggcaaggtcaagctggaaaaagagcttgaagaccttcgaattaatcaacgtccagaaattattaatcgtattaagatcgcacgtagctacggtgatttatcagaaaactctgagtatgaatcagcaaagaatgaacaaagcttgctagaaaaccggattaagacggttgaacacatgcttcaatatgctgaaatcatcgatagtgacaagattgacgaaacggaagtctccgttggtaaaatcgtgacgttcaaagaattacctgatgaagaaccagaaagctacaccattgttggtgctgccgaagctgatccaatggttggcaagatttctaatgattccccgatcgccaagggcttgattgggcatcacgttgatgaagaagttgccatcaacattccagccggtaccatgacggttaaaattttgaaggttgaaaacgcgtaattttatgcttaagactgttttgaggtagaggataccttgaaacagtcttttttggtggtttagaagcgcgattactgattaccagccactatttaacgaactgttactgaacaagcacgtttgcgtgtgagttcgggattcaagcaaaacaccgcttatctgcacaaagcaggtaaacgggtgagtaaattggacgtgttacatttttttagcatttactatgattaaaacatgccagttgtgtaggttcgaaaacagccagcttagacccgctggaaacagctcgaactcgcgtagacttttgttgtgggttcgtcctacgccgacctccaggcatttctgccaattgccggaacgtggtgggcacagatttgagccgaaacaccacgtctcaaatactggcctttcactaaccaagcaaaggacgcttgttaagtgaaatttcaccactgggcattgtcagaaacgccttccagtcgggatagtattcgaatggcagacggtgaggtacccaacttttgataaattggccattgcttttcaaaaacggtaattttgtcaatcaactgtcagactgagagtgatattgtacttaaggttccagtattaaaatagtcgacgaccaattgcaccaagttaagtggccgtttatcagccattcgagcgggtttccgaaatgtgctcggtaccactgaagcctgtgcgtgctacgccaacggactaatgccaaaaccgcattaatccgttggctaggcaatgctcggcttcaacccgtgacccctcacaggcttgagaccggaggggctgggtgacaatgctcagtagccaaattattcttagctggaagtgggttgcttccggcttagaataagactcgtatttgagatgacgcgggttatgcgttagctcaaatcgacgtcggctgcgttccagcaattggcacccagccccggaggtcggaataggacgcgcaagtgctgatgaacagtaatccaaccaactggcatgttttaatcatgattcatgacagattgatcaggatatggccgacagcaaagtagggttagatatagataattcgtaattcaccaagcgagacgctgccggttagtatgacacccgggccagcagtggtcggtgtacctgtcgatgagatgtggcccattgagttgctgagattttcctgtagctgccaagtttgagggaggtataactcaaggctacctaatgaaacgtcgacattgatggttgctcggccttctttgatgtcagcgtcatcgaagtagattttggcaccagccattgatacgttcagatccgcagaacgaaaattttcgctgtgaacgtagcggatactgttgcctagtgagagatctaaattaacatggtcatcgttgattgtgctcgttgattcatggacgtcatcgtggttatgatgattgtaatgagcatgatcatggttgtgatagcgataatgatattgataacggggatgaatcaaaagacccaaaccaatgctgagtaatacggcagcccctaaaattgtccatggtacgagcttagtgattccaagtggttgcgcatagatcatggttaagaatgcgatagcgaagacgacgcccggcatattcaagtaacgaaggctactaattaaagccgcaactagaatcaatgttaacaagagactccagatgctgacgtggagcgtgaagagaccgagttgactaacgataagaacaacggcgctggctattaagaagacgggccaaaaccaatttttatgcatttataacagtcctttctgttcaagacttattttgagttggcgatagtagcgtcttgaagcgtacagttgcttcgatgaataggatcgaagtaagcggtaactgtacgagttgaccacgttgtgaaacggttaacgtagcggcctcaattgaaagatttttgagagcagcagtgagggcggccgtttcggggtagtcgactggaacatgcagtgtgacggttggaattgaggtgtcgggctccgtttcaatgttcacttgcatgggtttcacctccttaagtagtttaagtacaccacaaaacaatgacgctgtaaataaagactcccttagcggtcatttcaggaacgcaactggtcattggcttgctcatcgactgtcaatgttgcgttttatgggcaaaaagggcacaattactgtaaacgatttcaatgatgaggtgttagtaatgaaaataacaattacagatttggccagtaagtggtttcatgatgacatgggtgtaaccactggtaatggggtgcgcttttacggcaaaacttatggcaagacagcagttcacagtggcttctcaatcgggatcatgcgtgatgacgaaccccatcaaccgattgccatggttgaaaaggatggtgtcaattactatgtcaacgaccgtgatgaatggttctttaagggctatgatctcacagttgattatgatgaacaaaatgacggcccgaagtatgactacacgcccaataacgagtagttctggtgagtgcttgccaatagcgattaatatttggacaaaaaatcagcgttgcctgaattaacaattcaggtaacgctgatttttgctgaccacatctttgactgtgaactgggctaggcgtggtggcgtcgacgccggacgataaaccaaccagccgttgcgagtgcactaatcccagtaatcagactaccagtgattaagaatggcggtcgatacgtcaaggtgaccgtatgcttgcccttacttaatgggacagcaacaaaggtattaatcactttcttagttgcgacggattttccatcaacagtggcatgccaacccttggagtaaggaatggtcgtcatcaaaacttggtgacgatgcttgatgttgattgtaccagtaatcttacgacttgagtgggccgtgatgttccaaggggattgctggagtttctgcgccgacttcttgaattgggtattatccaacttgtagagggtgaagttttgtaaccagagagaagtcttcttcatctgaatcccgaatgtcacggtcttgcccttgctattcgatgcaacgttaacagcgatcgtgtgccggtaagttgggtactgcttgagttccttaccgttaatgtagtaactcgcattcgaagtagttaggttttgcccgagcgtgatgtagtaggaatcattggttgtcggcgtgaacttaaagtaaaccgatcccgttttcgctaaattttgtttgttcaagacggcgccagttaacgtcgtgaccttcttaacgttttggaagaccacttcgttaaagttttcggcactgatcaagccgctggttgaacgatttgccaaggtttggtaaatcaactcttgccgggcaatcggatcgccagttgttttggagactttcaagctagtaatcttgtcagacgctgcgaaaccaagacccagggcgtatggatttttgtaggtcgtgactttgttagtgctgagctttgccgatttttggtaattcgtcagatctttcttggtactggtgaccggaatgtagctacgatagttcgcgttatcagtctgggatgtcggtactgttttatccataaagtactgcatgtccagtaacgaatcggtaatcatggtcccgttggtgtaggcgaccacaccgtccccatccggctgaccaattgaaccgaaaaagttagggataatactttcgaaggtcgaactgaaatgatcagcaccgttataggccgcctgcatcggatcgtctttagttcgtgtaaacgtcttaccaattcgataaaaacgattgttgctagctttaattttgttgacggcattgtcaaggacttgcgtgtatttaccaaactcactttgtgacacgtaggaaatattatttaatgaagcgaccacgttgatcgacatatcagtcgcaactaaaattaacgcgacgatttgataaatgagacgtcgttccttaggcaacgttaagaaaatcaatgtaattgctgccaagccaattgtaattaagagattagcttgggtgacgtaggtgactttcttaatgttcaagtaaatggttgtaaacaaaccgaccagcaatgcgagcatcgttagcgcttgccacagtttgatcgttattttgtctgtcagtgcttgggcaccaatccagacgacccagaaacaaaagacaaaggagaagcggtaagggtaccaaactggaaattggcccgcatgccacaataaatcaagtggttcgtaacaaaatgataagataagcgtcgcggttacaatcaaggcgctcaacttcacggaccatttgaactggcgccgtaggaagaagagcacaaaggcgagaactgctaaccatgccacgtaaaggttcggttgaccggatggcatctgatcgaagttgaaagtaccggtgacgaacttagctaacatcttccagggcgcgtattcaagtttccaatgaaccttggtcacattatattgagccttactttgaatgagcgcccagaaagttggtaatagcaaccatgcggagaatgcgacacctagcagaccaccccaagcaaatttgagggcgtgagttgctaaggtcttcacgttttgccaatacttagttgcaccatacaaccagtataaacaactgaataaaatgaccatgtagcccatataatagttgtcaattagcatgacggccagccagccagcgaagtaacggactttaccagttgtaaacaagcgttccagtcccaaaatgaccaatggtaaaatggcgaccgtgtctaaccagatcatgttgagctgattggcgaccatccagcccatcagtgcatatgcggtactgaaagttggcaccaaccaacccttttgcgtctgcgttttagttagtagccaggcgaaggatagccctgcgaaaccatactttagtacagtgacgataaaaatgccggtagtgattgattgaccagggaatagtaagtagattaaattaaagggactcattaagtaataagcccagaccccaaccatctcgccaccaatcgttttggagaaggaatagaagaaagcactcggatcgtgcagtagggtatgccggaaataggaaaacaagtcaacgtattgttggcctaaatcgaccgttaacagactgcttgatccaaagggagccatgtgccgataaataaaataaccggtcatgatcagtaaaggtaaccaaaagctgatccataatggccatgtgcgcttgtcaaaaaaacgacggagtttcaaaaattgccacctcaatctctaataattcacagccaaacagaaaaataatcaaaaaaacattaaaatccgtaataacggctgaaatttttatgtctatcgtttagaataacataagtatggtatttatctaggattgctagtatcatctggtaaatttttgcgaaatgtttaccaaattaagaatgggagcgcctgagaattgaaattgtttaagaaaattacgataaatcgtgatcccaacaagtcgcatattccatttcggctgaacttcttgtttttcatcgtcttcttgttatttgctgcgttgattgcgcagttagcttacttacaagttgactacggacagaagttccgaagtacagtgaattcagccaataatacgacggcaacgggaaacgttcaacggggatcgatttatgattcaaccggtcgggtcttagtgggaaacaaatcccaccaagcgattcaatacacgaaggggctgtcagttgcgtcgactaagatgtacgaagtggcgaataagttaggtgagtacttaaccattccaacggatacattaacggatcggaacttggctgattattacttagcgggggcggctaatttaaagtcggttgctaagaaggttaaaacgtctagcgacgatgatgttttgtacgcacgggaagtcgcctatgcggaaaaacatatcattaataatttaacgtctacgcaaaagaatgcggcggcgatttattataagatgagttcggcgtactcgctgtcaacggtcaatatcaaatcgactggtgtgacgagtacggagcttgctgaaatcggtgagcaccaatccgaaatgccaggagttaaggtcggaacgagttggactcggagttatcctaatgggactgacttgagtagtgtgctcgggacagttacgaccgaaaagcaagggttaccgagtgatagcattaaaaccttgctggcagaaggctattctcgtgatgattcggttggtcaaagccaattggaaaagcagtacgaaaatgtccttcgtggaaccaagtcacagactgaggtcaagacgcaggatggggtcattcaaaaggagattaagaagtacggtggccagaagggtgacaacgttcagctgacgattaattcgaagttccagaaaaaggttcaaagtatcattatgtctgaagccaaaacggtggggagtagtaatgcctactcgccaggagcctatgctgttgtaatgaaccctagcactggtgccatttatgcgttagcaggtgccagccggaatctatccactggtaaagtgactgaaaatgcgttgggaaccatcaaccaatccttcgttatggggtcggtcgttaagggtgccacggtcatgggtgccttgcaagatggtgtgattacacccacgaatagtactttgaccgatacgccaatcaagttagccggaacggccaccaagtcgtcatggtttaacaagaatggtggaactagtctgagtcttaacgcttcgactgccatggaagtttcttctaactcctatatgatgcaattagccatgaaggaaggtaacttcagctatgcgtctgggaaagccttgacgatgtctaattcggtcttttctaaacttcgtggttattttaacgagtttggcttaggtgttaagaccgggatcgacttgccgggtgaagcctcaggttaccaaggttcttcggcacagaaggatattggtaaagcgttagacttgtcctacgggaactacgatgcttacacgactattcagctggcgcaatacattgcgacaatggcaaatggtgggcaacgcattgcaccacacatcgtttccgctattactgggactaaatctaacgggtcccaaggggctgttaagactaatgttaagccacgtgtcctgaataccattgacgtcccatcctcatactttgatgtcgtacaccaagggtattgggatgtggtccatgggagtatgacgcagcggacggggagtgcactagctagtttatcaccagcggttgcagctaagtctgggactgccgagacattccacggaacgacatctactgaaacgttaagtttggtgacttatgcgccttataagaaccctaaagtagtgatagcggttgcctttccaggaattactgctactagtggtgattataatatggtcgttgctaagcaaatttatgcagcgttctggaagtattataacaagtaaaaaatcagcttttttcgtaccagtatcttaattgatactggtatttttcaatcattaatggtatagtagttcaagttaagggttccggccctgtaatatgcgaatgagtttggagggtcaacaacatgcgggtacacattacacttgaatgtacagaatgccatgaacgcaactacttatcttcaaagaaccgccggaacaatccggaccgggttgaatttaagaagtattgtccacgggaacacaaagtgacattacatcgtgaaacaaaataacaacggggactcctgttgttttttctgtaacattgtcatcagacaatgggtttctcatttgttggcaactgccaaattgatttttcaatttgacatgttaatgaatgagatttttttataccaattttattttcgggggtgccgtacgtggagaaaaaagcatttcgtaagcaacagcttgggcgattaagccaaatgacgccggctgaccggcaacggcaaaaccaggcgttacagacccaattatttgcaagcccaacatggcaaactgcccaggtcattgccatgacaattagtagtgacatcgaagtagcgacgcgcccacttattgaacaagcttgggcggagggcaaaatggtggttattccaaaaacgctgccgcatcgtcaaatggctttttatccttaccaagcgactgatcgacttgagcgaacgacttttggaattccagagcccgtcacgggtgaaccagtcgccaagcaacagatcgatctgatcttagttcctggtcttgggtacagccgtgaccggcacgcccggattggatttggtggtggctactacgatcgttacctcgctgattatccgggtaagaagttgacactggcttatgacgagatggcttttgaacacgctgaatggccggttgatcaatatgacgtcttgttagacgaactcttggtagcaggggatgaacaacatgatgagaattaaacgctggtggcaaactgaaccggctatcacgcaggtgctacttggaattactgtggcagtcttcttagtcgagtggctgatgggcgacggcgccatgctgatttttaattcactaggtgctaagaacaatcaagcaattgcggccggccagtggtggcgattggtgacgccgatgtttttacatatgggacttacccatattgcactgaatggtgtcgttatttattttatgggcatgcaaattgaagcaatgtatggtcactggcggatgctggcaatttatattttgggtggcattagtggtaatattatgagtttcgcgttatccaataatcagtcagtaggggccagtacggcgtgtttcgcactctttggtgcctttttgacgattggggaatcgttctgggaaaatccagtgattcgccagctcacgaaccaatttttactactaaccgttttgaatttagtattcgatatgttctcgaatggcattgatatctggggacatgtcgggggtctagttggtggctttttgttaggctatctgctgggtgtaccacgaattggcaagattgcgccgctgaaacgaattgtggcaacggttattctagtcattggctggttagctttactaaaaatgggttttacaaatgctaatttaactgtataattaatcgaggatatgcacatgaaaacactttacgacgtccaacaattacttaaaaaatttggcgtgtacgtgtacgtaggcaagcgaatttgggacattgagttaatggccattgagatcgatcatctctatcaagctggtgtcattgacccgaagatgtatgcccgcgtcaagctcgtattgagccatgagcaccggatagaagcagaacgcgcccgtgaagacgcggcgcatgactaatggagggatttagcaacatggagcgtaagttaatcggagtcgaccttggtgggacgacaactaagtttgccattttaacagaaaatggtgatattcaacaaaagtggagtattgaaaccacgattttagatgaaggggcccacattgtgcctaacatcatcgattccatcaaccaccacattgagttatataagatggaccgttctcaatttatcggaattggaatggggactcccgggaccgttgatttggataatggtacggttatcggtgcctacaacttaaactggaagaccttacaaccagttaaggctcaaatcgaaaagggaactggcatcaaatttacgctggataacgacgctaacgttgctgcacttggcgaacgttggaagggcgctggcgaaaacggtagtgacgttgtctttgtaacgcttggaactggtgttggtggtgggatcatcgccgatggccgtttactccatggtattgccggtggtgccggtgaaattggtcacgtaacggttgaaccaaacggctacatgtgtacttgtggtaagaaaggttgtttggaacaatacgcttctgcaactggtgtcgttcacgttgctcgcgatatggcagaagaattctctggtgcttctaagttgaaacaattattagacaacggtgaagaaattagttcaaagatcactttcgatttagctaaagaaggcgatgtcttggctaaacgcgttgttgatcgggtttcttattacttaggcttggcattagctaatgtcgggaacacgatgaacccatcttcaatcattatcggtggtggggtttcagctgctggtgatttcttattagatcaagtcatcagttactttaaccaattcacattcccaacgattcgcgacacgactgctttgaagttagcggtcttaggtaacgacgctggtgttatcggagcaggttcattggcccaacggtttatttaagttaaaatcaatcgtcaagaagcttggaagtaatgtccgagcttcttttttatactaagctccaaaaactgtgctgattaggttgtggttaaaaactgagcgccaattgccgatgctgatttgggctcatgtcctcagactatgcgcgattttagtttcatgtcggtatgttgttgtaacggcgtatgaactgttacgcgatttggcacaagggatacgaatcgactagcgtgaattgaattagatgacagaattgattggagaagcaggatggtaaagttattattgtcttcacgggcgtttagcactgtggccgtaacggacgcctttttcactttagtggcgccggtggctaagaacagtgcgagaattgtgattattgtcaattcggtcagcacgggtaaaaatcacccccaaatggtggcactacaacaaacggttcagcagcttggatatgcgcacgtgcagctcctagatgtattgacggatgatttggccgcattgaatacggcaacggtcattattttgaatggtggctacgagtttttactgttgaagaatctgcgtgaaacgcacgtgctggaacgactgaggactctcgcgctggcgggcaagccaatctacggtattagcgccggggctatcttgttaggcccggatttagacctgtacgcctatttatacccggaggacaacaccgagcaactggcaagcacaacagccatcaatgcgacgacgatccgtatttatccgcattatgatgttcattgtgaagtaaagccgcaattgccgcagttgatcactgactgggaacataagacgggcgttacggtcaaacggttgactaacaatcagggattactggtgcatggtagtcagattcagatgatcgattcagattcataaatgtgataccgcgatgcttggttttgaattaacagcgtggttaaatgcgggtctcaggcccccgaccgttttaatggatttctttaaaccgtgggtgagtacggccataaagcaatcagtgggacttcaggattagtcagcagtttaatcgcggcttttcctgcttacccctagtaaaagtaagcggttttgtgtaaaatagataagtagaaattaggagggataacgtggttttaggtgcattgagcggcatggcgtatgttaacatcgtgttagttatcataatcgcggcctactttatttatgagttgtatagttacattcgacggcgtcaggtgtccacgatgttggacgaagaagcgtttcaggcgggaatgcgtaaagcacaagtgattgatttgcgtgaaaagaaagagtttgacgctggtcatattctgggggctcggaatattccgttcaacagtttgaaagttcggatgaacgaacttcgcaaggatatgccaatctacgtttacgatcaaacccatacgttaagtacacgggccgtcgtcacattagctaagaatggttattcacagctatacattttaaaacccggttacgcacgttgggaaggtaagacgaaaaaagcgaagtattaaaaaatggcggctagaacaacaacttgttcggccaccattttttatttaattaaccgttgtgagctgagcgactcttgcgcatcgcctttttccggttttcttcgaatttgttttcttggtcttcgattggatcaacaacttgcttcttaaatgataagacggagccaattacggcaccagcagttgcgacgaccccaaacaagaagccacgggtaaatgatttcattagtaaaacctcctagcaattgttagttttattatgcttgttttatgcggagatagcaatcaattcaatctaatttttaaaaaagtggggtgaaacgcaatgcttactcaaattattgctcatcgtggtagcaagggaaccaggccggaaaatacgttaccagcgtttattgcggctatcgaggatggtgcggatggcattgagactgacgtacacttgtcgcgagacgggcaactgataattatgcatgatgagctcgtcgaccgcacgactaacggaacgggtcggattgtggatcacacgttggccgagttaaagcaattggacgctggtgttaagtatgcatcagcctatgcgggaacgcgtattccgactttagatgaagtggttcaattattgattcaatacaactttactggtatttttaatctggaaatcaaaactaataagattcattatgaggggatcgaagacttggtagcggattattttaaccatcatcaagttccgtttacgctaatttattcgagcttctacggaaagtcgatcgaacggttgcatattttacagcccgaggtcgaatcggatagcctgttcaagactaaggttcaaactgcgaagcggcttcatgcgcaacacattgttctcggttatcatccggatattcgttgggtgcgagttcactggctcttattgccaaaagtgcagttgcggccatggacggtcaacacggaacgcgatatgcggttctgttatcgtcatcggtttgcgggactgattaccgactaccctggattagcacgaagaattcgtaagcaggtacaaggaggttaaacgagtgacaacagtaactaaacataaagtattactaatcgcgggaccaacagcagtcggtaagacggcattatcgctagcgctggctaaacagctgaatggtgaaatcatttcaggagactcaatgcaggtctatcgtcacttggatattggtacggctaaaataatgccggaagagcaggcgggcattccccaccatctaatcgatatcaaaaatattgatcagcgttttacagtcgctgaatttgtcagtcggacgacggcgttgatcattgatattagtgctcggggtaaactgcctattattgtgggtggaactggcttttacttgcagtccttgttggcgggctatcagtttggaccagcggataatgaacctgatatggcgtatcgtcaagcttggtttgatcgtgccgctgtcgaaggttcggatgtggcgtggatggcgttgaaacagcgtgatccgcaggcggccaccgcaattgcgcccgctaacttggtacgggtcgtacgggcgttggagtacgtgcatacaactggtcagcttttttctgagcaggcggatacgcacggtgacacactggatgcttataccttatgtctgaccgcggagcgagcgctgctgtatactcggatcaatcaacgtgtcgatcaaatggtagcggccggattggaacaagaggcgcggtggctatttgaccaaggtggcgccatgttaccggctggtaaggggatcgggtatcacgaatggttcccttactttaatggggagcagacgcgtgacgaatcaattgctaagatcaaacaggactcacgtcgttatgcgaagcgtcagttgacttggttccgtaacaagatgtcggtcgactggatcaatctattggaacaccctgaattacgggcctcgattgaccaacggctagctagttggttaagctaaattataaattggtatacctatgataaaacgtgtgatattttctaacatgaatgattgacattcgatgataacattgctaatattaagtctgtattaaagaggagggtcgttatgaaggaaaaggaactccgtcgctcgttggccgtcttgccaattggtacggttatgaagctgaccaatttgtctgcgcgacaaattcgctactatgaagagcaagaattgattacgccggaacgaaatgccggtaatcggcgaatgttttcgttgaatgatgttgatcgtttgcttgaaatcaaggattacttagcagatggcatcaatatggctggaatcaaagaaatatatgcgctccaaaaacagcgagctgagcagaagcaagctgacttggctaagccgctaactgatcgcgatgtgcgccgaatccttcatgatgaattcctgaatctcggaggcttgcagtccgacaagggccccaattatccggcacactaagatgtttgcattcgttagtcaatcaatttaaggagcgattttcatggcaaaacagtcctactcaaaagacgatatccgccgcatcgtcaaagaagaaaacgttaattttttacggttaatgtttactgatctattcggcacaattaagaacgttgaagttccagtttcacaactcgacaaactcttggataacaagttgatgtttgacggttcatccatcgatgggtttgttcggatcgaagaaagtgacatgtacctgtatcctgacttatcaacttggttgatcatgccttggaacacggaacatggtaaaattgcacggattatctgtgaagtttacacgtctgaccgtaagccgttcgaaggggatccacggaacaacttaattcgtgtcttgaacgatatgcgcgaagcaggttatacgtcatttaactgtgggactgagcctgaattcttcttattcaagatgaatgaaaagggtggaccaacgaccgaattgaatgataagggaagttacttcgacttatcaccaatggacttgggtgaaaattgccgccgggacattgcacttgaacttgaacgacttggttttaacgttgaagccagccatcatgaagttgcacctggtcaacatgaaattgactttaagtacgcggatgctttatctgcagccgatcatatccaaacgttcaaattggtcgttaagaccatcgcacggaaatacaatttgtgggcaacctttatgcctaagccgttaaacggtgtcaatggttctgggatgcatgtgaacatgtccttgttccatgatcaaggcaatgccttttatgatgctaatgataagaatggcttagaattatcatcagacgcttatcacttcttaggtggtttgatgaagcatgcccggtcatacactgctgtcactaacccgacagtcaactcatacaaacgcttggttcctggatatgaagcgcccgtttacgtggcctggtcagcatctaaccggtcaccaatgattcggattccaagtgcacggggcttgtcaacgcgccttgaattacggagtgtggacgcttcaactaacccatatttggcctttgcagcggttcttgaagctggcttggacggaatcaagaacggtattgaaccaccaaagagtgttgatcgtaatatctatgttatggatgaagatgaacgggctgcagctggtatcgctgacttaccatcaacgttacacaatgcgctgaaagagttccagacagatccgacgatgaagaaggcgttagggccacatatttatcagagtttcttggaagctaaacggcttgaatgggcttcataccgtcaacaagttagtgaatgggaacgtgatcagtacatggaattgtactaaaccattaattgagataaaaatacgacggttagggcaccttaaatggcgaactagccgtttttgttataaaattggtaaattagtggtgttaacctttattaatgcactaattttcggtaacattaggaacagcaatgcaattcagcaagttttcaattattattgattgcaaggagattattatggaaaaacaaaatcagcctgatcttgaaaaacaagatcaacctacgcgcgcgcttacgaagcgacttcaacaaaagttagactatgtaactacggtgcgccaagcaattacggctggtgacgaccggttgatctacgaattgatcgatggtgaccactatcaccaagccttacttaacgaggaaccggatccaacccgtaacgcccaagtggatttaattacggatgtctatccggcaatcagtcactacttgagtaccaagttaattgattatttggctcatgagtacccattcttttattatgaagaaacccaactcggcgaatttcagatttactttggtaactggtgggatcggcgccggtttggtaaattgaacgttttgaaagtcgcctttgaatttagttcggaagaatacaataaattacaaaagacgtttgaactggctcccgcgcacaaacgtttcaatacagatcgtattcagcagatctcagctggtagcgatcagctacagaaactgattgacgcgcaatcagaccgtgatgcgcaaaaagaagaattgcggcagcaactaaaggaaaatgggcaacgtaactcactatttgattctggtcggatcaaagaagaacggcagcaaattattgaccagttaactaagttggccgatgaagacgaacaagctaataatgcccatgcaaccatgaaggataacgaagctaagattttaacgctttctaaggaagatacgattttagcttatgagaaacaagcgattgaaaacgcctttaagagttttgagaattttaatgagcgtaaccgtagtctttatgttgactacttgaccacgctgattgggaaggcgcaggtagcggctgatggcgaataatacggacaagcagatggacacggcaacactgagcactcacggtaagctgagtacgttcaatgagggcttaaaaaaaggactcgctaatggtgaaaaatttacggccttgatggaccaactgattgatacaactgacggggagacactgttagcagcggcacaacagctagcagactttaaactggatacggcttacgtgacgtttccccatcaatatcagaatgccgattattatttgatcttcatgagtcggttattgggcatgcatggtgatgaacaagcggtgctgaattctcaacggcatactgaagcgctgtatcacgtttacggggcgctaacggatgattacaccttcttgtatcaagtggtgaacaacggcaacggtggtgcatattatcgtgaacaaacaactggcgaaaacttgttttatattcatttagaacggcgcttgttacggtttaatagttcggcgtttacgaatttatttattaataaattattgttgaaggggactggggttgaccaaattaatacggttctcgcaacgctaattaaatttggacattgcttacaagatgattttggctttaacgtcgactttaatattttggacgttgctaacgcggctaaatatgaacttcggtcggctaatttagatcgggcaatcgttgacaaattgtttgtcagtgcggctaagaatgagcacatgttgcgtaattcacagcaaggacatggtgcccaaattgaactgcgggctggtttgacagttgatatctttgatgcagctgaagctggcggtagtcaacaatgggtcctgactgttcatgatcctgatcaagcagtttcgtggtttgacgtgttgttacactttgggttcatgcgtgattggtacttagaaaatatcgattcgctagaaataaaagcggatccattagtatttgcttaagtaacgggggtattagatgttagaactaacaacgttattacaacagtcgattcgtttagaccgcgatattacggcccgtcaacagattcattggcggccacaagaacggttgcaaaatgcgatggtctcactggacgtcgaattggcagaaatggctaatacgtcggaatggttcaaagtttggaagattcatcgtggcaaagcggatcctgataagacacaccgcgcaacgctgctgaacgaatacgtagatgcgatggacttcttcttccttgtctcagcgattcaacagtggacgcatttgattccagtaacgcctgagcaattgactacgattgcggctaagccggcgactgatttgaataaacagtacttggcgatcaagcacctcctctatgatgcttactttaaccatcgtcaggagagctaccagcacgcttggcacgttttcttgaagattgggctagttgattttggctttactcaggacgagatacagacggcgtttacggccaaaaatcatgtcaatgagcaacgacaagcaaataactattaaaaaaataacctaattgcgcgatttgatcacgtaactaggttattttttaagcctctgtcattaattgcgcgtcgttatcggcgtcttgtgcaactaagtcattaacttggtcgatcaatgtttgtcgttgatcaagatcatcgtcgcattcaaagaaggccccgagttcctcagctaaagtatctttgcccgcatccatataccgaaagtcattgctggtgatcgtatagtgctggtgatctggcatccggacgatgacacaaccagtggctgactttcccttggtggctttgtccgtaaactcgaccgcgagtacgtagggcccgtcagttgaacgatctttgatggcatgcgcgatatttccggcaattgcttcaagtttcaatatgtttcacctcaaaacatattatacgcactattaggatgggatgcgagaattgatttagtccatcagctgctcggccagccgcttctgttcagcgtagaaagcgttaaaggcgtggtgggcgttgatgactaggtggtaatggtgctgtgcgactaataagttatgatgaaattcaaaggtgtcacgcccttgctgaataaacgttaagtaatcgttcagataaatgttactggttaagccatggcgtaaaagcattgttgattcccccagacagtattagatacgttgattgtactacaccaaggttgtggtggattggacggtgtcttgattgtaaattggtattataaacgacgactgttacaattttgatattttcagtttgtcttccaccaaattaattggatagaatgcaatttttaggtaatagggtgatattgtccaatgcggcaaatgctctttcactcatacaagctgtgaacctaatacttttgtttttttatgtggatgctcagtttaggtagttgttgacctttttaatatctatgccgtcaattggctgatttaataagcacgaatacgatttggctgccgaaatttattagaaaccaaaaatagagaagtttgctaaacgttggtttaacaagcttctctattttaaaatggcaggtccgaatcgatggtatgtcacgagtgagacttgaactcacaaccctccgcttagaaggcggatgctctatccagttgagctaccgtgacaacaacaagattaattatagttaagaagctggagagtgtcaatttttatttaatttttcaccgatgtgcagcagttaaaaaaggcgtgagtaagcagaatgatgtaaaaatgtaatatttgtaatgaaaaagcactaaattacagtaagcacattttgctgagataattggtcattatggtgaaagtcaaaaatgaagttagcctggtgaacgaggaaattgttttcatgaataccaattaatgcttgaagaacgacacaatataaacgctgtaatagcggtaactaagtccggtcatcattaatttaatttttgcaagacggggttgttaaatggcgacggcgaagaaccaatatctcctaaaatacttaagaaaagataaagaaattaacaaaactgactaaaatagtttatttcacttgaaatgttactgtaacaaaactataataatcatgtaacaaggaaggagaattcttatgggttcagtatttgcaatcgtcgggatcatcgccatcgctggtggcattcaatattattcaaactttgttgccaaagaaaatgcaagcagtaagcatttcactgcttcccgtaatgaccgttagtcaacgggagttcttatcttgcacattggcattatacaatcaatcaattaaaaaagaactgctcattcaagatgagcagttcttttttaattacttgatttttggtgttttttcgatggtgtcagtcttgccggcagcccaacgttggatagcagcaacttctttttcgcgacgaatgcgcttttgcttcccagcaactggccgacgtgatgcccatgtgttatatggttttgcaacaacagtcataagagtatgtccctcctttgattagtccaataacgactatattaaacaagaatagtgtacattgcaaccgaattaacaggaaaagccagacttttcccaaaaattgcattattagtataacggttattttggtcggttgtcaagataaaatcctttacagcgtttctaaagatcaatttagctttgaattgatgctaaggcatgtaaggactaaccagctagtatgatagtggcaggtaggtgagccccatatcaatcatgtgtcagtcgaatgaatgggccagatagatcactgagaaccatcttagacgtaatctaactatttgtccggctgattatcatctgttagacgctcttagtaattaatgttatattaattatgaaatgaaagtagggagcagatatgagtcatgaagttgatccgcgtgtcgataaaactcggcggcgcttgcgacaagcattaattacactattacagacagaaacagtcgataacatttccgtgcaaaaactgactagtacggcagcagttacccgcggaacattttatctccactataaagacaagccagcatttgttgatcaggccctagatgacttggtaagtgaattgtttgaaacggccatcgtgacggtttcagtgggtgatattatgaccaatccggctgacccgttacagcgggtgcatgttttttccttatcaaaggcactcggttacatcagtcagcacgcggaagcctttgagacgctattgttagatcagcgccagttagcggtcaatcaacggatcaatcagcagatgacgacgtggatgacgaaatttcaccgtgattttcaggatcaatttgctgatttggaagtaccggtcagcattcaaatcgcgtattacgtttctgcgacagtcggcctgattactgattggttagctaatgatatgatctacacgccacattacttaaccaagtgtattaaaaaaatgcaccatttgatgacggtagggagcattagtttcacggacttttttgtgaagtgaaatcaatccttgactattatgaaaaaatttgataatattttcctgttgtatttgtggacttctacagctacaaccgcacggattgagtcttaagttcagcaatggcacttacattcggcgagtctaagtgatttataatttaaggaggtgcacaaacgtgtacgcaattattgtaactggtggtaaacaatataaagttgaagcaggccaagcaatttacgttgaaaaacttgacgctgctgctggcgacaaggttacttttgatcaagtagtctttgttggtggtgacacaactaaggttggaacgccgactgttgatggtgcgacggttgaaggtactgttgaaaagcaaggccgtgaccgtaaagtggttactttcaagtacaaggccaagaagggccaacatactaagaagggtcatcgccaaccatacactaaggtaacgatcgacacaattaatgcataattaagaaagtaggcattctttatgattcaggcaaccatttctcgtaatgcgaccggtcaagtgaccgcttttaagttgacgggacatgctgattcaggtgcttatggacaagacatcgtttgtgcagcggtttcggtgttagcaattagtacaatcaatgggattgaacaagttgcccgcttgcaacccgtagtacaaagtgatgaaaccaatggtgggctattaattgcagatttcactaagctggacttggcgaacacacaattacaaaccttacttgaaagtttcacacttggtttgaacgatgtggccacgaattacggagattacatccgagttcgtgaacaaacacgataaccacattcggaggtggactttactatgttaatgaacttgcaattcttctctcaccataaaggtggcggttcaactgccaacggtcgggattcagctggtcggcgtttaggcgctaagcgggctgacggccaaactgttaagaatggtaacattctttatcgtcaacgcggaacccatatttacccaggtgtaaacgttggccgtggtggcgacgatacattatttgcaatggctgacggtgtcgttcgttttgaacgcaaaggtcgcgacaagcgccaagtatctgtttacccagcaaaataatttttgaagagcctctgcagggaggctctttttttgtgaagcaatctagggatacctgcgactattattggttcacgggccgcttagccgtaaacgtaattgattgacgaatggccttcaataaatcattaccttcagtttttggaaagtttggtataatgaagcgtgaggtaatgatgggagtgacgaaataatgagtcgagttgaacggttacaaaataagtttgatcagttaaaaattgatgcgtttttagtttcagatggagctaatcttcaatatttaacaggaatggctgatatggccggcgatggttatctgctagtactggcacaggaagcctatctgattacggatgcccgttatcagacagcttttgccggtcagtatgatgaccagcacctagtcattacacgtgattatctgggggccgtttttgatattattgccaaaaccggtactggggtcatgggcttcgaggccgagattccatatacagcctacagttacttagatgagaacttggtcagtgatttggttgcgttaccagacgtggtcgatgagttgcgcatcaccaagagtgttgatgagattgaccggctacgagcgagtgcacgtttggcggatgctggtttcgaatacgtaacgagtatcgtgcgaccaggcatgcgtgaaatcgacgttagcaacctgttagacgcgtttatgcggacgcacggtgcaagtgggccgtcgttcacgacaatcgtacttggtggtgcacgagcggctttgccacatgggacggcttctaaagcactcttgacggccgggcaacttgttactcttgattttggttactttttggacgggtacacgtcagatatgacacggacgtttgctttaggtactccggatgataagttggttacggcctaccaggcggtgcaggccgctcaacaggctgtgatcgatcaggtccaagcaggagcagccactgctcaactggatgcagttggccgcgatttgctgacaaaagcgggctatggtgacgccttcaatcatggtatgggtcacggcattggtcttgccattcatgaaggcccgttgatctcaaaaaacacgactggcaccttagttgcaaacagtgtgattactgttgaacccggggtatatttcccagatttaggcggaatgcggatcgaagatgatgtcttagtgactgctgagggccatgaacgactgacgactgcaactcgtgatttactgattttatagttaagacagttgccacagcggctcggtcttgttatagttataaagatatatttgaggaggatttttaaaaatgatttcaactgcagattttaaaaatggtttgacgattgaagtagacaatgcaatttggcgcatcgtggaattccagcacgttaagcctggtaagggtggcgcgtttgttcgttcaaagcttaagaacttacggacaggagccgttcaagacaagactttccgtgccggtgcgcggatggaacaagcgccaattgaaaagagtacgatgcaatacctttatgccgatggtgacagctatgtcttcatgaatacggaaacttatgaacaaattgaaattcctggcgaccacattcaagacgaattgaaattcttgaaggaaaacatggaagttcaagtaacgctttataagggtgaagtgttgggaatcgatttgccaaacacggttactttggaagttgctgaaactgaaccagggattaagggtgataccgcttccggtggctccaagccagctacgttggaaactggtgcaattattcaggtaccattcttcgttaaggccggtgacaagctgatcgttaacaccgttgactccacgtacgtttcacgggcttaatttttagaaaaactaataccggcaaacatggaattggaggaatgtcaaaatggctgacagtagcaatattacgttacaaagcaaagaacccagcttaggacaaattcaaattgcaccagaagtgcttgaaataatcgttggtatcgcggtaagtcaaattgatggcgttaaccggatgcaagggacgatttcttccagtgtaaatgagttgttcggtcgcaagaagaatcttggtaagggtgtcaagttaacaatcgtcgatgatcagattagtgttgatgtgttcgcatacttggactatggtgtttcggtaccaaaagtcgctttagcgattcaagataaggtcaagcaacaaatcttatttatgaccgacctcgccttaagtgaagtcaatgtccacatcactggtatcgtgactgagaagactgaaagtgccattgatccaaacaacttgtttggtgatgaagatacccagaccgatgaaaatgaagatggtgaagaatcgtgagtttaacgcgtcatgaaatccgggaaaaagcatttcaagctttattcgcgttgaatgctaacccagacgctgatgaaaatcagttgttccaacagttactcaaccctgaagaagcggatgcagttgaaattcccgcatatttaagtacgttagtaactggtgttcgtgaacatcaagttgaattagacgctcaaattcagccttatttaagtcagaagtggtcgttggaccgactggctaagaccgatttgattatcttacgcatcgcgttctttgaattgcaatttgttgacgacgttccaactaaggtcgcggttaatgaagcaattgaattgacaaaggcgttcagtgatgaccgctctcggaaattcgttagcggggtgcttggtaaagtggttaaaaaccaagccaattagtctaaaaccgaacaatcttatgttctaccgtaaaagtctggcgatttgccagactttttttaataacttattagtaaaccggtcataaatcattgtggtgaatatgctaaaataagaccagacagagaaagaggagtgtggcacttgtgacgaagattattgatggtaaggcagtagctaagaaagttaacgcgcagacggcaacggcagtagcggaattggctgctcagggaattcaaccagggattgctgtaattattgttggggacgatgcagccagtcaaatctatgttcgaaataagaatcgtaaagccactaagttggggatgcactccgtggtgcggcagttgccagcgactactagtcaggacgaactgttagccattattgcggcatacaatgcggatgacagcattcatggcatcttggtgcagtcgccactaccagcccaaattaatgaaccattgatcacgatggccattgatcctaaaaaggacgtcgatggttttcacccgacgaacgttggtaagttgatcaccaattttccaggtaattatcctgtagcaaatacgcctcgcggtattatgacgatgttggctgactatggggttgatccggctggtaaaacggcggttgttattggtcggagtaccattgttggtaagccgatggccgctttgttaacaaatgctaacgcaactgtaacgattgcacatagtaaaacagctgacctaaaggcggtagcccggacggcggatatcttggtggttgcaacggggattgcacacctgatcactggtgctgatatcaaaccaggcgcgacggtcattgatgttggcatggatcgtgatgaaaatggtaaactagtgggtgacgtcgattttgattctgctcaaggcatcgcagggttgattacgcccgttcctggtggtgtgggtccaatgacgattgccaccttgatgcagacaacggtggaacttgcaaagtggagtgatgtaagtgagtgaaagtcaacaatatttgacagtgacagctttaactcagtatttaaaacgtaaattcgaggttgatccgtatttaggtaaagtgtacctaacgggggaagtttctaattatcgtccccggcctaatacgcatcaatatttcagtttgaaagatgaccatgccaagatttcagccattatgttcaagtcggcgtttgccaaggtcaaatttcagcctgaagaaggtatgaaggttctggtcgtgggccggattggtctgtatgagcccagtggtagttaccagatttatgtggaacgcatggaaccagacggcgtgggtgcgttgtatcaagcctacgaacaacttaaaaagaaattagcggctgagggcttgtttagtgcacccaaaaagccgcttccgcgctttccaaagcgaattgcagtggtcactagtcgtagtggcgcagtgattcgcgatattatcacgactactcggcgccgttttccgattgcgcagatcgttttgtttccatctcaagttcaaggtgatgcggctgcggccgaaattagtcggcagatagaacgtgccaatgcgcaaggtgattttgatacattaattattgggcgtggtggcggttcaatcgaagatctgtggccattcaacgaagaagtggttgcgcgtgcaatcgcacagagtcaactgccagttatttcatccgtggggcatgaaacggatacgacaattgctgacttggtcgcagatgtgcgggcggccaccccaactgcggctgccgaattagcggtaccagtatataacgatgttttattacaattaaagcaagaccagacccgcgtgttcaatgcatttcagaatttcgttcaacgcgatcgacaacgacttaataaattacaaacgtcgtacgtgtttactcagccgaaccgcttgtacgaagggtatttgcagaagttagacttcttaaatgagcgacttaaacaggctggtcaaaataactttaatctggcaagccagcactaccagcgtgtttttcaacaattacgacagcaaacgccgattcaccaagttcgccaggcacaaacgcaactgcttaacttgcagcaacggctgaatcggggtacccagttagtcgtgcggcaaaaacggcaacaactgacgcagaccgtccaatcgttggatctacttagtccgcttaaaatcatgacgcgtggttacgcctttgtgacggcggatgaacaggtggttcacggggtcaaacaattgcagccagaacaaacggttgcaattcacatggctgatggtgaggctcaggcacagattacgaagattgatggaggaaaataatggctgaacaaccaacttttgaacagaatttatcacaattagagacgatcgtaaaccaattagagcagggtgatgttcctttagaacaagccttggatcaatttcaaaagggcgtggcacttagcaagcagttgaaagcaacccttgaaggtgctgaaaaggcgctcactaagatgatgaatgaaaatggcgacgaagttccgtttgagcaagctgacgccaatgaataagcaattattaactgaatttgaatccaagtggcgtcctcagattaatcagtatttagatgagcagcttcaagcgtgttctgaccaatcaaccctgactgacgccatgcgttattcggtactagcaggtggcaaacggttacggccgttattgacgttagccattttagatacttttgatatcacaacgacggctgcaaacttgcgggcaagtgtggccgttgagttgatgcatacttattcgctaattcacgatgatttaccggcgatggataatgatcagctacgacgtggcgaaccgactaaccatgttaagtttggggaagacgttgccattcttgcaggggatgctttacaaccgttgactttcgaatggattgcggatagtgggttaccggcatcgatcgtcgctaatcaaaccttagcattagcgcaggccaccggacctcgcgggatggtggctggtcaagttgctgatgtccttggagcgggacaacatctggctttgccagccttacaacagctgcatcgcgagaagacgggggcgttaattcactacgctgtccaggcagggttgattcaagctcaagtgcaaccagccgtgcaggaattgctattacaatatgctgatgcctatggattggcgtttcaaatttatgatgatattttagacgtgacgagtacgcctgatcagttaggaaaagctacgcataaggatgccgatgaacataagaatacgtatccaggtttgctggggcttgcaggcgcacgaacagcgttagaacaagcggtaacagctgctcaaacggcgttagtaaaagctagtgctgctagtcaacgaggcatgggcttgcttgcagcttttctaacgtattttacagattaaggacttaaatttagatggaaaaagaacgagttgacgtattattagtacaacaaggattatttgatacccgcgaaaaggctaagcgtgccgtaatggccggtgaaatcttaggtgtcaacgaagaacgcttagataagccgggcatgaagatcccagtggcaactgaattacatttgaaaggcaaaccgatgccctacgtttcacgtggcggtctcaaacttgaaaaagcactcaaaagttttgaaattgacgtgaccgacaaaacggtcctagatattggctcgtcgactggtggttttaccgacgtggttttacaaaatggggcaaaaatgagttacgccttggatgtcggtagtaatcagttggtctggaagttacgccaagatccgcgcgtggttgtgatggaacatactaactttcggtatagtaagctggcagatttcacgcaggggcaacctaactttgcgtccatcgacgtttcatttatttcactacacttaattttgcccccattacacgcgattattgaaaacggtggttcagtcgttgccctaatcaagccacaatttgaggctggtcgtgagaatgtcggcaaacacggaattgtccgtgatcctgctgttcatcaggcggtgttgacagatatcgtggaatttgcgcaagcgaatggttataacgttctagggcttgattattcaccaatcaagggtggtgaaggtaatattgagtttctaattcatctacaagctaccgatgaaacaccacggattgcgccgactgtgtcgattgaaaaaactcaggcggccgcttatgaacaattaaatcaagcttaaaattgaaatccggactttcatatttatgcattttggcttatgatgtgtttaaataagtatgaatagctaccgggggtgatcgggtgaagaagcaagagcgccaacgctacattaaacgattattgagttcgaacgaaattgaacgtcaagaagactttgtcaagctgttacgtgctgaagatattgacgtgacacaggcaaccatttcgcgcgatattaaagatatgcagctggtcaaggttccctcggcaacgggcggttaccactatagtatgccagttcagaaacaaatggatacggagaaaaagctcaagcggacactgaaagatgcttatgtctcgtatgcgactcaggataaatttgtcctcatcaaggtgttgccgggtaacggaccagcactagcaacgttgattgaagcaatgcattatgacgaaatttttggaacgctaggcgatgatgctcacgttctgattatttgcaagtcgttagcgatgactttagagctacaacaaaaaattcaacgcttactgagtgatcactaattagtaagctatcttcgacctgctcacatgtgtgtcaggtcgctttttttcaaaattaactaacggatgctggtaaccaattgcttttaaggagggcttgcagtgttacaagaattatcaattacgaactttgcaattatcgaacacttagacattgcttttgaagccggcatgacggttttaactggtgagaccggtgctggtaagtcaattattattgatgcagtcggtttattagcgggtggccgcggctcggcagagtttattcggaccggtgctgataaagccgttttgcaaggcatgtttattttgccggctgacggcgtgacggcccaattgttggacgaagcggggatcgaacatgcagataataccgtcattctacagcgcgagattactaaaagtggccgtaatacatgtcgcatcaatggtatgctggtcaatacgacgactttgaaacagattggtgaaacaattgttgatattcatggtcagaatgaacatcaagagttgatgcaacctgaaaaacacctgggattactggacgagtttgccgccgctaaaattcgtaaattgaagcagcgttaccagcaacagtatgatcgttatcagcagttaaaccttgaattacggcaaaagaatgcgaatgaaaaagagtgggctcaacgcttagatatgctgaactttcaagtggacgaaatcgcagcagcacaagtcaaagtgggtgaagaggccagcttgactgcggaacgtgaccgcttggataattaccaaatgatcaatcaagcgcttcaacagagttacacattgttagctgcaggcgaagagacgactggtgcggttgatatggtcggtacggcgatgaatgcactagaaccgattgccaatttggaccccgcttttaatgaaattaccgtgaatgtcaagaatgccttttatgggctgcaggatgcggccggtcagatttctaatcagctcgatttgcaagaattcgacgagggtcgcttggatgaaatcgaacagcggctggacatcttggcccagttaaaacgtaagtatggggactctgaacaacaaatcttagattattaccaaaaaatcgcggctgagttagctaagatgactgactctgaagaaaatagtgaagatctggcccagcgggtcgccgacctgaaacaacaactacttacgacgggcgaagcgttgtccgataaacggcgggctgcggcgaaagtgttacaacgacagatccatcaagaactcaaagatctgtatatggataaggcaatctttgaagtacgattcaaaccgactaagggtcagatctatcggagtggtctggacagtgttgaattttatattcagactaatcctggcgagcgcatgcggccattggccaaaattgcgtctggtggggaactctcacggatgatgctggctttgaaaaccattttttctgaatcacagggaattaccagtatcatttttgacgaagttgatacgggcgttagcggtcgggtcgctcaagcgattgctgagaaaatcaacggcattgcacacttttcacaagtgctctgtattacccatttgccacaggttgcggcgatgagtgatcaccactacttcattgccaagaagattactggtaagcgcacgaaaacgagtgtgactaagctagataatgcggcccgggttcaagaattggcacgcatgctggcgggaactaaggtcactaagttatcgcttgagcatgcggaagagttattgcgactggccgatgaggaaaaagacgattaagtttaattgattggtaccacaagggacggacaactatggtcggtccttttttgatggtgttaattagtgacgatggtgtcgagtgaggtttcggtattattgccaaggcgacgataattctttacaatataaaacgcaaatagacgaaatatgggtcaacggacacgttttaatgaactgtcgggctggttggtagtgggtggctaatctgaagctccgactaccaaaatataccgttaaaacgataaaatgttcagtttacatgtcatgacgtttgcattttgctttcgttataagttatgcttaattacagtacagtttattcggcaacgaaataaactgagtaaatgattggagtgatgaggttgtttctgacaatggaacatttgaataaaacgtatcctggtggcaaagtagccgttgaagattttaatttggaaatcgaaaaaggtgaatttgtttgtttcatcgggacgtctggttcaggtaaaacgaccacgatgcggatgattaatcggatgttaagtcagacttccggtaccattaaacttaatggtaaggatattagccagattgacccggttaaattacggcgacaaatcggttatgtgattcaaaacattgggctaatgccccatatgacgattcgagacaatatcactttggtaccacgattgctaaagtggccccaagataaaatgaatgaacgtgctaagaagatgatcaagctggtggaattgccagaagattacttggatcggtacccgtcggagctttccggtgggcaacaacaacggatcggggttgttcgggcgttagcagcagaccaagatttagtattgatggatgaaccatttggggcgttagacccgattacccgtgaatctttgcaagatctcgttaaggatttgcaggaacgcttaggtaagacattcgtctttgtaacccatgatatggatgaggcgttaaaattagcgacccgaatcgtaatcatggatggtggcgacattatgcaagtggatacgccagacggtatcttacgtcatccagctaatgaattcgttgagaacttaattggtaaggatcgcttgattcaagcacggccaagtattaccactgttgggcaagtgatgttgaaagacccaattgccaccacaccaggaaagtcattgacggtcgcattacgacaaatgcatgataaacgcgttgactcgttgttagtcaccgatgaagccggcatcttgaagggtgtgatcggcattgaagacgttgattacaactttaactcggctactagtgtgggtgacattatgaagactgatttgttctatgttcagtcaaattcattgattcgggatacagtcgaacgtattttgaaacgcggcttgaagaacattccagtcgtagatgaacaacatcgcctggtcggaattgtaacgcgggccaccctggtcgatattgtttatgatgctctctggggtgatgaagacgaagatgaagctgaaaataatattcatcatggggaggacgatgcgcccgctgaaggcggtgaacaggcatgataactttcctacaaaactacggcatgcagctgctggttaagacgtggcaacacttgtatatttcagcgttttcattgttcttaggcattatcgtagcggttccgattggaattctgcttacgcgggtgaagccgattgcgaatgtggtcatgtcaatcgctagtatgttacaaacgatcccagcgatggcgttgttggcattgatgatcccgtttttcgggattggtgcaattccagctatcattgcgctgttcatctattctttattaccgattctccgcaatacctatcttggactggaagacgttgatccggccttgatcgatgcggctaagggaatgggaatgaccggttggcagtcaattgttaaagttgagttaccgatggcagccccagttattatggctggtattcgattatccgcaacgtacgttattgcctgggccgcgttagcatcatacattggtgccggtggccttggggactttatctttaatgggttaaacctctatcgaactgacttgattttaggtggttcgattccggtgattatcttagccctcatcgttgattggctgttgggtaaactggaagcagcggttaccccgagaaccacacaagcgtaagggggattaaagatgaagaaaattaaaaagtggttgttaggtgttttcgcaacggtcgctagtgcgttattattggccggctgtggctttccgggtttgtcaggaacttcatccgatacgatccggattgcgtcacaaaacacgactgaacaacagatcatggcgtacatgattcaagatatgattaagcattattctaatttgaatacgacgatcattaataatttaggttctgggacggttagtttcaatgccttgaagaatgatcaggctgatatttcagcgattcgttacactgggacggacttaacgacgattctgggcgaaaagatggatcggagtaatatcaagtcgattgaccaaaaagttcgctcacagttcaacagcaagtatcaaatgacctatttcccaagttatgggttcgcagatacctatgcttttatggtgacgaaagcgacggccaaaaaatatcatctaaatacggttagtgatatgaaaaaagtagcctcgaagctgacggtcggtttggatcaaatctggactgaacgaaaaggtgacggttatcctgcctttaagaagttgtatggctttcaatttgggaagacttatccaatgcaaattggtttagtttatgatgccttggaatcaggtaaaatggatgccatcctcggatactcgactgacggtcggattggtagttatgatctgaagattttaaaggatgataagaatttcttcccaccatacaatgcgagtgcggttgcaacgaacaagatcttgaaagctcatccgaagttgaagccaatcttgaatcgattaaacggtaaaatcagcttaaagacgatgcaaaacttgaactatcaagttgataataacttagtggaaccggaagttgtggctaaacagttccttgaaaaacataattactttgaagggagtgacaaataatggctcagatgaacttactgcaacagttgatatattattaccaacaaaacggtgtgtacgtgttaagccagttctcacgtcacttcttgatttcaatttatggcgtgctgtttgcggcaattgttgggattccaattggcattttcattgcccatcatagtcgattgagtgcgacagtgatcgcgattgccaatgtgattcaaacgattccgtcactagcgatgttatcaatcatcatgattggtttgggcctaggtgtgaacacggtaatcgtcacggtctttttatacgcgttgctaccgattatcaagaatacctatactggaatgcaaaatgtgagtgctagtattttggattccggtaaggggatggggatgacgcgttggcaattgttacgaatggtggagttgccactgtcactttccgtcattatggctggactccggaacgcattagtgttggctatcgggattacggccattgggaccttcgttggtgccggcggtttaggggatatcattattcgaggaaccaatgctacgaatggtggtgccattatcttggccggggcgttaccaacagccttaatggcaatcattgctgatacggtcttggcttggattgaaaagcgtgctgatccaactcaaaaataacgtcagtgagcgacaagtaaaagaagcaatataaaaattaagttactaaaaaagattgatttacaggtactccgtactcactcattcagggaagtcagtggagctgtaacatcaatctttttgatttgcatcaaaaacaccatgagaatacgcaaggttgtattgaacatgatttcatcttttgatgcaagtattaatgattaaactaaacgcgtttgatataacggatggcgtccgggtcgaccaagtgggtcaggtgtaactgccgattaactagaaccaactgaccactagcgagggtttttaacactccgtgaatattatatggtcgggactcagtgagctgaggctgcatctggagcatgatttgatagtgttccgtgtgcgcttgagctaagaacaaatcccgctggaaagccggcatcattggcagtaacggcgcaacgacggtcggggcagcagtaaagtcatccataaattggcgataggaagcgtgtaagttcttggaaattagtttcaaattagattgttgattttgcatattagccacctcgaacatttgtttgtgtttccattatacgaacaggtgttctaaaaagcaagcctaaaatttgagaaaattcacgaataaaaatgaaaaaaagctgtgtaaccttgataatacttgcaatatagggttaaaaagtgcaaaataaactttaaaacatattttaattaaggggaatttgtgatcatggcgaaacaaggcatgttaatcgtcttatcaggtccttcgggtgtcggtaaaggtaccgtccgcaaggaaatctttgactcagatgataacgattttcaatattcagtctcgatgacgacgcggcaaatgcgtccgggcgaagtagatggcaaggactactattttgtgtccaaagaagagttcgaggatgaaattaagagcggcggtatgcttgaatatgccaagtatgttgacaattactatgggacgcccttaaaatatattaagcagtcgttggcggctggcaaagacgttttcttagaaattgaagttaacggggccatgcaagtccgcgaaaaaatgcctgatggcgtcttcattttcttgacgccgccggatttgatggaattgaagcaccgcatcattggtcgtgggactgatgatatgagtgtgatcaacaagcggatggcaaaagcggttgatgaaatcaagatgatgcgtaattatgattatgcggttatcaatgatgaagtcccgctagctgctgaacgaatcaaggctattattcgtagtgaacggtttagtgttaaacgggtcatgcccgagtatgaagaaatgttaggagatgcggaatcatgatcttatatccatcagttgatgacttattgaagcaagttaattcgcgttactcattgattatgttagctagcaagcgggcccatgaattggacgctggtgcagcaccaatgcttagcgaatacaaatcggttaaaacgattggtcgggccatggaagaaattgcggccggtgacttaatgatcgatccagatgaaactgacaaagattagtaacaaaacggtgtgctgagccagctggggcttggcactttttttatgaagaatgacgcggacgttcagcttcacgttactgtcgattcttgatacaattgttttattaaagtgtaaaaatctcgctggcacgattgcgagatttttcaaaggacgtgaagaagtgagtatatggacaaaacgccatgtaacggtagtcgttagtggtgggattgcgagttataaagcgttagtattgattcgtagtttgatgaaacagggcgccgtcgtgcgagttgcaatgacgacccatgcggcaaagtttgtcacgccattgacctttcaaactttaacgcagcagccagtggtcattgatgagttcacaacgactgacccgcatcacgtcgtccacgtcgcgttagctgactggactgaagtgatgattctcgttccggctaccgccaacttgattgctaaggtggctaacggtctagccgatgatgccgcaacgacgacaattttagcgacgaccgcacccaagtttgtggtgccagcaatgaattcacatatgtacgctaatccagcaactcagcgcaatttgaagcagctgacgacggatgggttacacgtcttaactcctgctacgggtatgttggcggaaggctatagtggtcaagggcgcttgccggaaccagcagtgattttagcctggttgacagatcaactgattcagttgacacctgatttgccattggcaggacggcgagttgtcgtcactgccggcggaacccgagaagccttagatccggtacgatttatcacgaatcgttcatcggggaagatgggctacgcagttgctcaagtcgcacgggagttaggtgcaactgtgacactgatcagcgcaacgactcatttagcagcgcctagtggtgttaaggtcgtgacggttgattcggctcaatccttattgacggcagtcagtgatatttttgatgatacggatatcttggtcatggcggcggccgtatctgattatcggccggctgaattagctgatcagaagattaaaaagccagctgaccatgctgacttaacgttacgattgacagaaacaccggatattttaaaaacgttagcggcccggaagcaccaacagtatgtgattggttttgcagctgaaacgcaatcattgctggctaatgccaatcgtaagttaactagtaaaaaattagatttaattgttgctaacgatgtttccaaaccgggagttgggttcaatggtgatactaatcaggtcacactgttgcggcctgggcaacaaccagttacgacggaattgacaacgaaaactgcaattgccaaacagatcttgatgacggcaattgcggatggtgcaggaacacaggcatgattaagtagagaggaagagttgtgtggcacaaattgcccaagtattagtcgatgtgcccactatgcagacaaatcgaccttatagttatcgaattccaaccgcctggcaatcacaagtgcaacccggcatgcgcgtcgtggtgccgttcggccgtggtaaacggcgggtgcaggggtttgtgttagctcttgatgacgttaccaactttgatggtgagctgaaaccaatcgacgcggtcgttgacctagcaccggttctgaatactgaagccctagcattgaccaagtggttggcagccagcacgttttcatttcagattacctgtgcacagactatgctgccggcggtcatgcgtgcaaagtatgaaaaacagttgcgaacaacagcaacaacgcccgcgacgattcgaacgacgttgtttggggaccaatcgatggtgccgtttgatgacgtcgccacgacgccggcaatcgtcagccagttattacggctgcaggcggctgggcaagtcgatgtgtactaccaagttaaaaatcaagcacggcgtaaaacgcaaacggcggtgaaagcggccttaactaacgaagcgctaaaggctgcagtgggccaggtacgcgccggggctacacaacaattggcagtgctccaggggttgctcactttaaatggtgaacagctctcgcaaaaggcgttttgtactcgttttgatgtcacggacggtgccattcgtacagcagtacagaaaggctggcttaaaaaagtggccgtcgaggtttatcgtgatccctacgcaactagtgatattaagactaccaaggcgttacaattgaatgatgaacagcaagtggccgtcgatcagattacgcaagccgttgaccaagccgcaaccaccacgttcttgttagagggtgtgacggggagtggtaagactgaggtgtacttgcaatcgatggcggccgcattggcacaaggaaaaacggcgttgatgttagtgccggagatttcactgacaccccaaatggttcaacgcgtgaaggggcgctttggtaaagctgttgccgttttgcacagtggattgtccagtggtgagaagtatgatgagtggcggcgaatccaacgaggtgaggctcaggtggtggttggcgcacgctcagcggtgtttgccccgctaaaaaatcttggcttaatcgtgatggatgaagaacatgagagcacgtataagcaggatgatgccccgcgttatcatgctcggcaagtggctttatggcgtagtcgttatcataactgtccagtcgtactgggctcggcgaccccatcgttagaaacgcgcgcccgcgcagaaaagggcgtttatcagcgcttactgcttgcggatcgggtcaatcaacggccccttcctgaggtttcaattattgatatgaaaaaggaaatgcaacaacacgctgaaagcaatttctcagcaccactgttagttgccttgcaggatcggcttgaacgtcatgagcagagtgttctaatgctcaatcggcggggctattcatcgtttgtgttgtgccgagattgtggttttgtcttgaagtgtcctaattgtgatatttcactcacgctacacatggatacgcacacgatgaagtgccattactgcggtcacgaagaagccattccgcggaattgtccgaactgtcatagtcgtcagatccgttattatgggacgggaactgaaaaagtcgaagaagaattgcaagacttgcttccggacgctaacattattcggatggacaatgatacgacccgtaaaaagggcgcccatgccaagcttttagcacagtttgggagtggtgaagctgatattttgattggtacccagatgattgcgaagggactggattttcctaatgtgaccttggtcggtgtcttgaatgccgatacggccctaggattgccggattttcgcgccagtgaacggaccttccaactattaacccaggtgagtggtcgagctggacgggcggaaaagagtggtcacgtgtatattcagacatttaatccggatcattatgcgattcggtttgcacaacaccacgattacgaaggctttttcaagtatgagatgcagatgcggcaccggggtggctatccgccgtactactttacggttcaaattacagcgagtgacttagatgaaggggtagcagccaagcgcatgtatcagttactgcaatggttacgcccgcggttggcaccgtcaacgattctattaggcccaacgcccaagccgatcgcacgagtcaatcgccgttattattatcaaatcgtgattaaatataaacaagaacccaatttagctcagacgctgacaacgctactgcatgagacgcaggcgcaacaacgacaagggctacagattggaattgacgtggaacccttacatttcatgtaatgggattaggaggaagtttgacaatgacatcaatcgtttttatgggaacgcccgcgtttgcggcaccgattctcgaaagtttaattaaagaacaataccaggtactaggcgttgtgacccagccagaccgaaaagttggtcgcaaacacgtcttaacagcttcgccagtcaaagaagtcgcggttgcccatgatattcccgtcttccaaccggaaaagattagtggtagtcctgaaatgcaacagattattgacttgcagcccgatttaattgtgacggccgcctttggacagtttttaccaacaaaattgttgaaagctgccaaaattggtgccgttaatgtccatggctcgttgttgcctaagtatcgtggtggcgcgcctgttcaatattcaattatcaacggtgagtctgaaactggaattactatcatttacatggttaaaaagatggatgcgggcgatatgctggcgcagcgtgcgattccaattgaaaaaaacgatgacaccgggacgatgtttgataagttgagcttagttggtcgcgacttgttactggaaacgttgcccaagttgattgctggcgaaattacggcggtgccacaggatgaatcccaagtgacctttgcaccgaacattcggccagaacaagaggttttagacttctttacaaaaacggccgttgaaattgataatcaagttcggggcatgcggccagcaccaatcgcctatgcggtcttggatggaaagcgcacgaagttctgggatgtgacccccttagctgacgaagtggtcacgcaagctcctggacaagtggttcgcaagacgaaacatgagcttgtgattgcagctgctgaccacacagcgattgcaatcaatcagttgcagccagctggtaaaccgaagatgacaattacagactatttaaatggggcggcagataagttcgctaccggagagcaggttattaataaatgagtacagttggtaataccccccgctggttagcggtcgccgccttagcgaagattaagaacggtgcatattcaaatttgcaattaaaccagttaatcaatgatcatcagatggatcggcgtgacattaatctgctgacaaatatggtttacggtgtcattcaacatcggttgactctcgaatactggttgaccccgtttgttcgacatccgcaccagattgacccctgggtacgggagctcttattgagcgcattgtatcaatggcagtatctggataagattccacaacgggccgttttcaacgaaacgattgaaattgctaaggtcaaaggtcaccctggcattcggcggtttgtaaccggcgtcttacatcaaatggatcgctcaggactaccgagttttgatgcgattaaagatcctgatgaacggttgagtgtgacttatagcatgccaatatggttgattcaagaattgcggcgtcaattaggtgctgaaaagatggagcgaatcttatcatcattgaaccaaccagctaagcaagccttacgtgtcaacccggccttgtcgacggttgaagatgtgacaacggcgctgattaatgatggtttgacaattacgccgagtgaaatctcaccgttagggctgattgcaacggatggtcaggccattaatactgaagcgatgcggtatggcatgttcacagttcaagatgaaagtacacaattagttgtgccagcactcaatccgcagccgaatgatcgagtcttggatgcttgtgcggcccccgggggcaagacgacccagattgcggctagtttagatgctgagcagggtggcacagtcgttgcccttgatattcatgccaataaagtgaaactgatcggtcaaaatgcggcgcgcatgcacgttgctgatcgcgttgaggccaccgaactcgatgcccgtaaagttgagacgcagtttaatgctgaaagttttgatcgaattttagtcgatgctccgtgttcgggactgggattgatgcgccggaagcctgagattcgctatgagaaacagttgcaggatagtttgaacttgcaacgaattcagctggcaattttgacagcggtcgccccaaccttgaaaaaaggtggtatcatgacgtatagtacgtgcacgattttgcaacaggaaaatcaggatgtgattaccaaattcttagcggatcacccagattttgagctgcaaacaacgccaactgaacgagacttgaaaactgatcgaacggaaaagactttgtcgatttatcccgatgattatttatccgacggctttttcattgcttgtttgcgaaaaaaataatggtggagtggtaaacaatggattttgcataccggtcggatattggccaacaacgtgaagaaaatgaggactatgtcggcttttttcaaaataaagcgggcatcaattttgcaattgttgcggacggtattggtggccaccaggggggcgatgtcgcttccgagatggcagtctcgcacatgggttttcggtttgaaaatacaacattcaaggaacccaatgatgccgtcaagtggctagcaagtgaagttcaagatgaaaatcagcatattattgaaaaggcccgtgaattttcagatctaaacggcatgggtacgacaatggtcgccgctttgctttttgatcaaaagtttttgatggctaacattggtgatagtcggggctatctttttcgcgatgggcaactccaccaactgacggaggatcattctttagtcaatgagttggtcaagcgaggagagatttcagccgaacaggcccgacaacatccgcagaaaaatattattacgcggacactaggcatctcaccagatgcggatatcgatacgaacctttaccagatacaacctggggaccaattgttattatgttcagatgggctgacgaatatggtgactgaccaacagcttgcgacggttttggcaacgacgcagacttcgacccagaagtgtgagacgttgatcaaattagccaatgcagctggtggtaaggataacattacggcgctgctgatggcgcttgatggtgaggtggccagtaaatgacacccaactatacccttagcggacgatatcggatcgttcggtccttaggtgaaggtgggatggccaacgtttacttggcacatgacttaatattagatcgtgatgttgcggtcaaactgctccggttagacttacgtgatgatcctaagaccatcaagcgattccaacgtgaggcactggcaacgacggaacttgttcacccccacattgtcagtttgtacgatattggcgaagaaaatggcatgcaatacttggtcatggaatacgtcaaagggatggatcttaaaaattatattaaagagaactttccgttaccgttacagcaagtaatcgacatcatggagcagatattaagtgccgtggcaacggcccacgcgcataatattattcatcgggatttaaaaccacaaaatattttaattgatgagcagggcaatgctaaaatcactgatttcggtattgcggtcgcgttatctgaacataccatgacgcagactaacacgattttaggttcggtccattatttgtcaccggaacaggcccgcggtagcatggcgacaaaacaatcggatatctattcgttagggattattttatatgagatgttaacaggctcagttcctttcaagggtgagacggcagtttccattgcgttaaagcattttcaaaatgcaatgccatccgtgcgagagtttgatgcggatattccgcaggcacttgaaaacgtcgtcttgcaggcgacaacgaaagatccacgggaacgttatgctacggtcgaggacatggccgctgacttattgacggtgcttgctagtaaccgtgcgggcgaaaagcgctttgtaccgcaagatgtcggtaatgatgagactaagatcatgcccagtgcggatattcaagcagcaattgcggccaatcaagacggtaagacccaggtcgtggcgcataaaagcaagcaaccaacactccagcgcccggctgaaacgactgagagtcagacagatgctgatgaagaaccgttaccaacacgttcttggtccaaacgacatccgttgcggcgtcggctcctcttttggggcggtattattttgttattagtcgtggccgtgatcgtcggtttggaattaagtcggccacagatgacgacggtgccgaaagtaacgggcttaagtcagcgtgccgcaactaaggtcctcaaaaaacaccatctcacggtcgggactgttcaacatgctaaaagtaatcaggtagccaaaaatcaggtgatcaaatcaacgcccagtgttaagacgcgggtccaagaacgtgctcgcattaatttggttatcagtaacggtgccaaggttatgagctttggtaattatgtcaatgataattaccatgatgttcgacagacgcttaaatcggcggggtttaaagttaaggaaacttacagtacgtcgtcggttgcagcagggcaaatcatcagtcaggatgttgtcgctggtagtcgcgtgatgccgacagatacgacggtgacgtttacggtcagcgctggtagccgctacgtcgagctaaaagatttaactggtgagagcaagagcgacattctggactatgctgaagcaaatgatcttaatgttaactttaagcagggctactcttcggaacagaaggcaggttattcctatgatcaagatccagatggcggtggcaatgtccggactgggtcgactattacggtgaccatgtcaaggggcagtgataataatgtgacgacaccacagaatttttatgttaaactaacggtgccatacaaagcgttatcggccaccactgcccaggccaacgatgttaagatttatttgtatgatgatacccatatgattgagaccgtttatcgcgatattgcaatcatgcggtcgactaagattagtttaccgtttcagctgaccggtaatacgaaggggcattaccgaatcgtgcgtaacggggttacgatcatggaaaagaagaatattacaagcaaaaatgcaacaaaataaagataagtcatgcgcaatgcatgacttttttggtacaatagagaaaagtggaccgtaccaaataatataaaaggtggtgctaatttgaaaattggacaaattcggcaatcgctaagcggcttttatgacgtttatgctgatggccaaatgtatcggacccgtgcacgcgggaatttccggaagcggcggattacgccacttgtcggcgacaatgtggagtttgatgcggcgaccccacaagagggctacgtgttaaatattcttgatcgacagacccagttggtacggccgccagtggctaatgttgatttaggtatcgtggtaaccgctacaacggaacaagaattttcaacgaatttattggatcgacaactggtagctttggcagtggcaggtattgaaccattactctactttgcgaagactgatttactaaccgatgaggtgtaccaacaacgattaacattagcggacgcttatcggcagattggttaccaggtcatctgcgaacgaaccgcattttcaccggccgccttagccgcagttaaaacggctctggctggtcatgtggcggttgtcatgggccaaactggtgctggtaagtcaacactgctaaatcatttacaaccagggctggcgttagcgactggtgaaatctcgcaggcgctgaatcgtgggaaacatacgacccgtaaagtcagcttgatcccgattgcggatgggttggtcgctgatacgccgggtttctcatcctatgaagttttcgatattgccgctaacgagttgacccattattttccagagtttgtgcgacttagcgctgattgcaaataccgaggctgtgtgcatattaacgaaccgcaatgtgcggttaaacaggcattggcagctggggagctgttagcgagtcgctatgataattatttacaattctatgaaaccattaaaaataaaaaagtaatctataataagaaaaagtgagtgagactaatgattaaagttgccccttcaattttaagtgcagattttgcgaaccttcaacgtgacgttcagatggctgaaaatgccggtgccgatgcgttgcatattgacgtgatggatggtcagtttgtccccaacttgtcattcggaatgagtactgtggcggatttacggccagtaacgtcattaatgttagattgtcatttaatgattatggacccagagcggtttgttgggcagtttgcaaaggccggtgcagatttgattggtgtgcacgttgaaagtacccgtcacatttatcacgccttacaattaatcaaagatgctggtgtgaaagccgaagtggtcgtgaaccccggaacaccactcagcatgattagtgaattattgccactagtggatcaagttttgattatgaccgtcaatcctggttttggtggtcaacattttctggaccaaatggttgctaaaattgcggcgttgaacgaattgaagcaacaacacggttatcaatttgagattgaagttgatggtggaatcaacgaccagaccgtcaaggcgtgctatgaagctggtgctacggtcgctgttgctggttcgtatgtctatgacagtgcggacccagcgcaacgtattcaagatttgaaggtggcgaccaattaatggcaaccatcgtaaacttactggttggcggaccgaccgctaattatccagcagatttaacgacgattccaggaccatgggtcggcgctgaccgtggcgcgttgcgtttggtgaaacgtggtatccagcccgtgatggtcgtaggtgattttgattcaattgatgcggctgaactccagactgtcaaagatgcgttggtgggcgctgtcgttgtcaaacccgaccaagaccatacggatacacaattggcgattaaatccattttcgagcagttgcaaccggatgaagtgcatctatatggtgccacgggtggtcggttagaccatttactggccaatatgtggttagtacttgatccggtatttcgtcagtgggctccgcagatcaaactgattgataagcaaaattcggttcggttctttctaccaggggactaccagatcacgaaggaagcggataaacgctatttggcgtttgtaccgctgatgccgatgcatctcacgttacccgatgaaaagtatcagttggacgctgcttataatgcgtacccgatttcatgggccagtaacgaattcagtggcaatactggtcactttagctttgatgcgggggttctagctgttattcaaagtcgtgatgacagcatggcagatgcgtagggtaccccaaggtttcagctaaaataagaccggtcggtgagtcataaactcatcaaccggtcttttaatatgcagtaacgacgtatcatcggggagcttgttggtgaaacgtgctgatgtttaggtcggtggtcgttagtagacctaaccggaaagcttatgttgaagcagaactttttggtcagacccagctggttgtttccgacgatggtacggcaagcaccctcaatgattcaggtcatcataatgggctggtcaaggctgaattataaactttataaaaagttgacgagaaattagtaattttagacaacaaaaaacgccagccacaaaaaaatgtgctggcgatttgctgcgctaaacgcgcgtaactttacctgatttcaaagtccgagctgaaacccaaaccttctttggtttaccatcaactaaaatgcgaactttttgcaagttagctttccagctgcggcggctgtggtttaaagcgtgagaacgcgtgttaccaaagtgcgtccgtttgcctgtaacgtagtcttttgccatgttgatctgcctccttcggtaattcattgataaaaggtcgtctttatcattcactagaataatttatcatagattaataaaggttgcaatacatttctatcaagtaattttactttactgctaaattcccagtttccgggcttctgttaagcagtcgcttaatttttctttcaagagtggttgtgctatgataaactatcgtaaatgaacgcgttaaaacaaggaggctattttcatggctgtcaaaatcaaaacgcaatttggaaccattgatattgataatgatgttatcgcgacggtcgtcggtggcgccgcaacggataactacggggttgtcggtatggcgagtcggaaccagattcgtgataatgttaatgaaattttacgccgcgaaaactatgcgcgcggtgtggttgttcgtcaagaggataatggggtggctattgatgtcaacattatcgtcagttatgggaccaaaatttcagaagtctcacgcaatgtccaagccaaggtcaaatataacttacaaaacatgcttggcgttacggccaattcggtcaacgtcattgtccaaggtgtccgggtaatgaacgactaaattgatgttggtggaagccaaggaggaattttgaaattgaaaatcaccacgattactaatcttgaatttggcaaaatggtgcaggctgcttcacaaaagctgaaccaacgtgctgaatttattaattctttgaacgtctttccggtaccagatggtgataccgggactaatatgagcttatcgatggccagcggtgccaaatatgaacgtgaagaaaccagtacaaaagtaggcgacctagcgtcagccttagccaagggactcttgatgggggcccgtggtaattctggtgtgattctatcacaaatttttcggggcttttctaaagccgtagcggataaggagagcttaaccgctaacgatttagcagccgccctcgcagccggtgctcagaccgcctacaaggccgttatgaagccgactgaaggaactatcctcactgtcatccgcaaagctgctggtgccggtaaggaagctgttaaaacgaccgatgatatttgtgaagttatggatgccgtcgttacggctgctgaagctgcattgaagtccacgccggacttgttacccgttttaaaacaagttggggttgttgattccggtggtcaggggctgaccttcgtgctggaagcctttagtgactcattaagcggcaaggtcgacgaatcacaggactatgttccggacgatgctgaaatggattcgatgattgatgctgcccaccatcaaagtgtgcaggggcaattagacccgaatgatatcaagtatggctactgtaccgaaattatggtgcgaatcggcgatggtaagttagttgatcacaagttcgactatgacactttctatgagtacttagcaaaattgggcgattcattacttgtcatcaacgatgatgaaatcgttaaggtgcacgttcatacggaacatcctggcgatgtcatgacgtggggccaacgttttggggcgttgatcaaagttaaagttgataatatgcgtctacaacaagaaaccatcatggaacatgataaggaagacgaagcgcaagccgctgctgagcccgccttaccttcacaaccacaagttgatatgcatggttatgcgatcatctctgtgtcatcgggtgatgggatcggcaagctatttaagggcttgggtgtcaccgacatcattgctggtggtcaaacgatgaatccaagtaccgcggatatcgtcaaagctgttaatgacagtggtgcccaacaagcattagtattgccaaacaacaaaaacatctttttggcagctgaacaagctgcggaagttgccgatgtcccagttaaaattatccacagtcagacgatttcgcaaggcatgactgcaatgttggcattcaatgctgaagctgatttagacgataatcaggccgcgatggaagaaaccttgagtacggttgttagtggtcaagtcacacatgctgttcgcgacacgacgattgatggccttgaaatcaagaaagatgattacatgggcttagttgatggcaaaatcgtaattacgaatccagatcgcgataccgctgctttggatatggtcaaagccatgctcgacgaagatagcgaactcgtaacgattatttacggcaaggatgcaactaaaactgacgctgatcatttggcagctaaggtgcaagagttggatgatgaattagaaattgaaattcatgaaggtgaccaaccagtttacccattccttgtgtcagttgaataagactaaccgttaaaaatagggcttagcagtgatgctggggcctgtttttgtacggacggatacttcccgcgggattgaaacgttttttcggtataattaatattggtaaaggcaattattttagaaagggcggtggtcaggcatgggacaacagttgagtgacgcggttgcaactttaagtggtgtcggcccagcccgccaaaaaggtttagcggagcttgggattaatacgattgcagatctattgacctattatccctttcgctatgaagatctacaggtcaaagacgtcaatgaaatcgccgatcaagaaaaggtgacactaaagggtactgtggcttctgaacctgtgctagcacggtttggccgtaagaagaatcgcctgaattttcgcttgttaatcgaccatgacgtctatatggtgactttttttaatcaaccatacttgatgaaacagattgagactggccaagatttagccgtttatggcaagtgggacgccacgcgcagtagcttgacgggaatgaagatcatcaatcccaataatgcggattcagcgtttggttcgatttatccggctagcaagacggtcaagcaggggacgattcataagatgatcaaacaagcatatgagttatatgccccagtcattacggacattgtgcctgctaacttacgagctaaataccgactgttaccgcggcgccaaatgattcatgatatgcacttcccagctagtcaagccgattcaacggccgctcgacgctcagcgacctacgaggagttcttgttgtttcaaatgcaaatgcaagttctgaagcaaacggacgcgacgacgaacggtattgcgatcggttatgacaatgaccgactaaaggcgtttattaaaacactgccatttgaattgacccacgcccaaaaacgtgtcgtcaatgaaatttgtttggatttgaagtcaccgaagcatatgaatcggttgcttcaaggtgacgtggggtccgggaaaacgattgtggctgccattgtcatgtatgcggcgattaccgctggttatcaggccgcgttgatggcgccaaccgaaattttggctgaacaacacgcaaataacttggcccaggtctttgccgacacggatgtcaacgttgcgctgttaacgggtgcgaccaagccagctgcccgcaagacattgttagcagcgctggctgctggtgagatcaacttattgattggcacgcacgccctgatccaggacggggtgacttatgctaatttgggattagttattaccgatgagcaacatcgctttggggttaaccaacgggccgcctttcgtcaaaaaggcgggcaacctgatgcactagccatgacggcaacaccaattccaaggacattggcgattacggcgtatggtgaaatggacgtttctgaaattgatgaattaccggctggtcggcaaccgattcaaaccacttgggtacggagcaaccaagctaattcggcgctaagctttgttcatcaacagattgacaatggatcgcaagcctatgtggtgacaccattgattgaggaatccgagacgctggatgttaaaaacgccgaggctctgtcagctaatttacaagagtattttggggcgagtgttaaagttggactgttgcacggtcgaatgaaacctgaggaaaaagacgcggtcatggcggcttttaaggcgggagacattcagttacttgtttccacgaccgtgattgaagtgggggttgacgtcaagaatgccacaatcatgatgatttatgatgctgaccgttttggcttggcgcaactacatcaattacgcggacgcgtcggtcgtgggaccaaggcttcatactgtattttggtggctgatcccaagaaccagcaagggattgagcggatgcagatcatgacgcagacaacaaatggttttgttttggcacaaaaagacttagaattacgaggagccggtgatgtgctgggtgtcaagcaatcgggaatgccggaatttaaagtgggtgatccgattgcggatttgaccgtgctacaagttgcccagcaagatgcccacgcaatcgtgcagcaaccggattggcaaagtcaaccggataatcgggcactagccgcctatttgagccagaagttggctgcggtgaggacgctcgattaataacctaaatacagtactgtgatgagaggaatggtgacacaatgattaaaattgcgattgatgccatgggtggcgattacgcccctaacgctgtgatcgagggggtcgaacaggctcgtgatttatttgaggatacggtctttttattatatggtcaacgcgatgtgattaacgcgcaactgaagaaccgtgatcggattcaaatcatcaatgctgatgaagttattacgatggaggatgaacccgtacgtgccgttcgccgtaagaagcattcatcaatcgtaatggcggctcaggccgtgaaggatggccaggcggacgccttcttttctgccggtaattcgggggccgttctggcggccgggttatttatcgtgggccggatcaagggcatcgaccgaccgggattagtgacggtattgccagtggtacgcaatgctaaccaatcgaactttgtgatgatggatattggtgctaatgctgatagtaagccactgaacttgcaacaatacggtgtgttagggacgtactatgcagaacggatgatgcaagctaagcatccacgggttgccttactcaataacgggacggaagatgacaagggaaataaggtccataaggcagcgtttgaactcttgtcacagactgacggtatcaattttgtcggtaatgttgaatcccgggacttattgaacggggttgctgatgtcgtcgtaacggatggttttacgggtaacgccgttttgaagagcattgaaggtacggcgcgttccatgctcggtttagtgaaagatgccgtctataacaccggtatcagtggcaagttaggcggcctattgcttaagaatgggtttaatgaaatccggtctcaaatggactattctcagtacggtggcgcggtcttactaggattgaaggcgccggtcgttaagacgcacggttccagcaaagcgccaacaatcgtgaatactatccgccaaattcgccagatggtcagtacggatatcgtcccaggagttgcggaatattttgctaatcaacaagctaatcagcaagcaagtgtagacattcctgctgaaaacgattagaatactttagtgaattcaagttagtgagggatctttacatgacgaaagaagaaattttcgataaaattgcggatatcattgctgatcggttcgaagttgataaagcaacgattaccaacgaaatgaacttgcaaaccgatttggatgctgattccatcgattttgttgagtttgtactggaattagaagacacctttggtagcgaaatctcagacgaagatgccgaaaaattgtcaacggtcggcgaagtcgtcgattacgtggcagcgcaccaagcaaaataagttaattgaccaagcaaaaacaggtagccaacatggttacctgtttttgcttgtctgactacgaaagtaccgatatcattgttattgaccactaaatcatagtataatgttatgatatgcaatgtgtgacctgttgactgactgattatcagatgaatccttacttaagcggacttttaacttgtgtttctatttgttagcttctgatcatccacggtcgattgccacggctgggtgaaactgaacattgcgtgtaagagtagcactgaatacatgtcggaagcactcgaacggcagatgaatgaccaccttaaataatgattcatgctaagttaggcaccaccagtaacagattgtgataactggctgatccaatggggttagtcgatagaatgataacgaaaggaagtttcaaatgattacagaattagctgaaatgttgaaggaacggtttggcattgtgtttaacgatcccgatttattggcggaggcgtttacacaagcctcgtatgtcaatgaacatcaggaccaacagttgaagtattacgaacgggtcgaatttttgggggatgccgtcttggagttagtggtgtccgaatatttatacaaacgttataaagacatgccccaaggtaagttgactcgtttacgggccgccatggtttgtgaagaaagttttgcaagctttgcccgtgaatgtgactttcctcagtacatccggttaggcaagggcgaacaaaaagcgcatgcttgggaacgagattcacttttatgtgatatttttgaatcatttgtcggggcactgtacctggatcaaggacgggaacctgttttgaagttcgttcatcaagtaatttttcctaagctggatgagggtcgttttgatggcgtttttgattataagacgaccttgcaagaatacttgcaacgggatggcgatgtcgcaatcgactatcaattaattgaacaagatggtccagccaatgagcggtcttatgagattgccgtacttgccgatggtcaaaaaatcggtgagggctgggggcattccaagaaggaagccgaacagagcgctgctcggcaagcttattcacaattacagcaaaagtaaccattaataattacaggaagtttgtgtcgaatgcaacttaaatcattagaaatcagcggatttaaatcatttgctgataaaaccaaaattgattttcaagccggaatgacgggaattgtcggcccaaacggtagtggtaagagtaacattattgaagctattcgctgggtcctcggagaacaggccgtcaaaagtttacgcggcactaagatgaccgacgtcatttttgccggctcggctaatcgaaaaccgttgaatatggctaaagtcacgatcacgtttgataacagtgaccactttttacctttggattacgcagaagttagtattacgcggaaactctttcgtaacggtgacagcgattatttaattaataatcagagttgccggttgaaagatattacgaatttgatgattgatactggtctgggaaaagactcattttcagtgatttctcaaggtcgtgttgaggcggtctttaatgcgaaaccagaagagcgccgcagcattatcgaagatgtcgctggggtcttaaagtacaaaaaggataagttcacgacggagaataaattagcggaaacgacggattatttagaccgcgtgaacgatatcattgctgaattgaatcagcaaaaggggccgttggaagaacaagcgagtcttgcccgggattatcaagatcaaaaacaaaaatttgattatttggaccgttcgcggctcgttaagaagttgacgattgctcgtgatcaactgcaaggtgtcaatgaaaagttagctagtgccaaggcgttagtggctaagtatcagcaacaagttgatgctggggcaaccaagctagctaatttaaaaacccagcagacagctcaattaaagcaaaaagatgagctggtagcacaaaatcttgagctgattaagaccatcgaaaacacgcaaggacaacaaggggttgacgctgaacggcggcaaaaccaacagtctgagcaggaacggctgacggccagtttgaccgcaactgagcaacagattgcgacgcaaaccgagcaacaaacccaattagaacaaacattatctgagcagcaagcccaagttaaggcagtcaaagcgcaagttgccgagttaacgacggcaacgagtgcggccggccgtcagcagttggctgatgagctggaaaaattacgcaatgcttatattgatgaaaaacaagttcaggctgaactgaataacgaagcgaagaacctcgttaagcaacatcaacagtctggcagtcagagcacagcgttagcagaacggctagctcaggctcaggctaacttgaaacgggtgcagacgaccgtggacgtgcacaatcgtgagcaacgtgatttagaaaatcaagtcagtcagcagcaggccacgctaacagcccaacaagcccaagtaaaaacgaatgcagagcggatcgacgagcaacagcaacgttggttagacgcggctggcttgatgcagcgtgaaaagtcacggctagaggcgttgcaagctgttcaggaacgctatacgaacttttatgcgggcgttcgaatggtcttacaacatcgccaacagtttagtggcgttgccggggccgtttcagaactcctgaccgttcctgatcagtatactaaggcggtcgaagttgcactgggcggacagttgcaaaatattgtttgtgacacacaacagacggctaaaactgttgttaatttcttaaaacaaaatcacgccggtcgggcaacctttttgcctatcgagcggatcacggctcgtcaacttcccgttaacactgagcgcgatttatcacaacaacctggtgtgttgggcgtggctagcgagttggtcgattgtgaatcacgattgacggcaatcaaacgttacttgttaggaacaacggcgattgtggacacgctagaccacgcgatggcaatttcacggagcagacgttttcggtgcaaattggtaaccattgatggtgaaacgattgcggccagtggggccatcaccggtggtgcgactcgccatgatgataatgggctactccaacagcaacaatccgcggaaaaaattgcagctaacgttgcccagatgcagtctgaattagtaacctatgaacaagggctagcagaccttaaaaaagctaaccaagacttgacggttcaggttgaaacgacccgccaacaactaagtgaacttaaggatcgccttagtcagacacaggcccagttacaggcggcacagagcgagcaaacgcagctaagtcgtcaagttaaggctttaacttatgagcagcaacagacgcaagctgatgatagctatgaagacttagtggctcgtaatcagcaagcgcaagcggctaatgcggctaagcttaaagactatcaggaccaaatgaaaacagtccaacaacagcaaacggattacgaaagttatcaacagactcaaacgacgaaattacaagcccagcgtgaacaactgatcacgttgcaggaacacgtgaaacaaacgcaacgacaattagaacaatgtcaggcgaccttggcgcaaaatgaagagacgaaaaagcaaattcaagcggatttagcagcaattaaaacaacgttagcgagccagcaaatgtcggtcgcagaacgcgatacggtcttgaaaacagctaaggctaaacaggctgcggttgaagaacaacggaaaacgtgtgaacaacagctagcaacgcttaatgatcaggttgaagaattatcgacccagcaagttcggttgcaacaactcgcagcggccgcaacggatgattaccgtcgcttggaattaagccaaacaaaattgactggcgaagtcgaccacgccacggctgatctggctgaaaagtaccagttgacagttgccgcggcacaagctgacgtcagtgacttagcgttacctgcgattacggaacagttgaaactgcttaaacgaggcttggatgagattggaacggtaaacctcggcgcaattgacgaattcgagcgggtcaaggaacgctttgactttctcaataaccaagcttccgatttaactgaagccaaggaacacttactgcaaacaatggctgatttggatacgaccgttgccacccgctttaaaacggcatttgatcaagtcgctagcgaatttagtacgatttttgaacagatgtttggcggcggtaaggctgaattgatcttgaccgacccagaacatttattgaccagtggggttgatatcatggcccagccaccgggcaaaaaatttcagcgattaagtttactttctggtggggaacgggcgttaacggctattacgttattatttgccattttagcagtgcgccccgtgccattcagtatcttagatgaagccgaagctgcgttagacgatgccaacgtggatcggttcagtcagtatttgaatgattttcaaacgggaacgcagtttgtgatcattactcatcgaaaaggaacaatgatgcacgctgacgtactttatggggtaaccatggaagagtcaggtgtctccaagatggtctcagtctccttggcagatttaaaagatgaacaaaaataattaaaggaagtgttgaagatgggactatttagtcggttaaaaaaagcgtttagtttaccagaatcagatgacgctcaaacaacgtcagctgccagtgaagcacctgcaacgacgagtcaagctaacgcaccggtcagtgacgaccgggccccttcgtcacaacagttagctcgctcggagggcgcaacaactgaatcaactgcgacaccggtgtccagtacagccgtaagcgaagcgacaagcactgcggacgaaccagcgacagtaaaatcggcagctactagtgaagccccggccgatagcacggcggcagtgagtgcacagtctggttcacaagcaccaatgcaatcggcgacggtgtcggaagcgccactcacagccagtgcaatggttgcccagtcactagctgcattaagtgcgagtgcggcacaagttagtcaagcggccgcgagcgacgtggcgttagcgactaagtctgatgcggtagttgaaggcaacgctatgtcagaatcagtagctagtacggcgccagcagtcaagtcatcagcgccaacagcgactgaatccgccgcaccgactgttaatgcggcggctgattcggaatcggctgagccggagccaactgaggcagaacgttatgatgaaggactgaaaaagtcgcggaaaacgtttggtgatcgtatcaatgccttcttggctaatttccgccatgtcgacgaagcgttcttcgatgatttggaagatacgctgatcgaatctgatgtgggttatgagaccgcgatgcgaattagtgacgagctacgtgacgaagttaaattaaagaacgcgaagagcaagaaagaaatttcaagcgtcatcgtcgaaaagctcgttgatatgtacggtgaagctggtgaaggcgaggataactcgattcacatggctaagagtggtccaaccgttattttatttgtcggggtcaatggtgctggtaagaccactacaatcggtaagatggcgaacatgtacaagcagcaaggcaagaaggtcttgttggcggcttgtgatacgtttagagctggtgcaatccagcagttgcaagtctgggggcaacgagacggggttgacgtggtcgctaaggccgaaaaaagtgatccagcggccgtttgctttgacgcggttaagaaggctaaggccgaagattatgacgtgctctttgtggacactgctggtcggcttcaaaacaaagtcaacttgatgaatgaattggaaaagatcaagcgggtcatcacccgtgaaatccctgatgcaccacacgaggtcttactggtgctggatgccacgactgggcaaaacgcgctgaaccaagccaagttgtttaaacagtcgacggatgtcagtgggattgtgttaactaaacttgatggtacggcacgtggtgggatcgtcttagctattcgtaatgaattgcatcttgctgtaaagtacgttggtttaggtgaaaaggtgactgatttacgaccattcaatgccaatgactttgtctacgggttatttaaagatattatcacgggttaaatcagttgatgatggtcttaaattgaaagccagttaacgaaatggtaattgttctcagcacgaggacgattaccatttatttttaccacaaatagcgactgatagttgacgaatggcgataaaatcggtactcttatttagtgtgtagtctgtatgataagcgtgaggagtccccacatggaaattgaaaaaaattatcgaatcaattcgttattcgagttttatgaaccgttattaacgaataagcaaaaagcctatattcaactgtactacgctgatgactattccttaggcgagattgcagcggagttctcagtttcgcgccaggccgtctatgataacatcaagcggaccgaaaagattttagaaggttatgaggctaagctgcatctctaccacgactttgtggaacgtaatcacgaagttgacgcgatctctgactatattaagcaaaattaccatggggatacccagttaattaagatgattcaacaactagtcaacttggaagctgactcagaataataataaaggttaggtgacactaatggcatttgaaggcctaacggaacgtttacaaaaagcaatgaccaatttacggcgcaaggggaagatttcggaaagtgatcttcgagcaaccatgcgtgaaattcggttagcattacttgaagccgacgttaactttacggtggtcaaggattttgttaaaacggttcgcgaacgtgcgctcggcgcaaaggtgctggaaggtttaaatccagcccaacaaatcgttaaaatcgttgatgaagaattaacgaaaacaatgggtgaaaaggcagttccactgaacaaatcgccgaagattccaacggtcatcatgatggctgggctccaaggggccgggaaaacgacgacggtcggaaaattagccctcaaattaaagaacgaacaggatgcccgaccattaatgattgcggccgacgtttaccggccagccgcgattgaacaattgcaacaagttggtcgccaaatcgacgttccagtcttccaactaggaaccgatgtcgatcccgttgagattgtgcgtcaagggatggcacaggcacaagaaaaccacaatgattacgtgtttattgatacggctggtcggttacaaatcgatgagcagttgatgaacgagttggccaatattaaagatctcgttcatcctgacgaaattttgttagtgatcgatgcgatgactggtcaaaacgccgttaatacggcggagggctttaacgataagctggatgtgaccggggtcgtcttgacgaagttagatggtgatactcgtggtggggctgcactatcaattcgggccgtcactggtaagccaatcaagtttgtcggtcaaggcgaaaagatgactgatcttgatgtcttccatccagaccggatggcggatcggattcttggtatgggtgatatgctgacgctgattgaaaaggcgcaacagcaatatgacgaaaaacaagccgaagaaatgaacctgaagattcaggaaaacacttttgacttcaatgactttatcgaccaattagaccaagttgacaagatggggaacatggaagatatcatgaagatgattcccggcatggctaacaatccagcgatgaaaaatatcaacatggacccgaaagacattgcccatatccgggcaatcgtttattcgatgaccaatgccgaaaaagcagatccggatttgttgaacccatctcggcgtcgacggattgcggctggttccgggcggccaattcatgaagtcaaccggatgatcaagcaattcaaccagaccaaaaagatgatgaatcaaatgtccaaagggaactttgctggtatggaaggtctcatgggtggtgccaatggcggtggcggtatcggtggtaagatgcaacaaatggccatgaagcgaatggttcgtcaaactaagaagaaaaaacaaaagcgcttagctaaagcaatgcggcgtcgcaaacgctaatttataagtttttttagcctgtcaagaaaaagtcctttacaagctattgatttactggtatattattacctgttaaagaattcgggaggtgtttaaatgtcagtcaagattcgtctaaagcggatgggttctaagaaaaatccattttaccggattgttgtcgcagattcacgttcaccacgtgatggtcgttttatcgcccaagtcggcacatacaacccacttacagaaccagcccaagttaaacttgaagaggaagatatcctcggttggttgaacaatggtgcccaaccttcagatacggttaagaatatcttatctaaggccggtatcatgaagaagtaccacgaagctaagttcactaaataataaagcggtaatagatcatggcagatattaaagctttaatcaccacggttgtcaccccgttagttcaatatccagacgatattaaagttgattttaaggaaaccacgcgttatcttgaatacaacttaacggttaatcccgaagatatcggccgggtcattggtcggcagggacgggttgcttcggcaattcggacaattgtgtatagtgtccgagtttcaggacctaaacgtgtccggcttacgatcgaagacggacaacaaaaaaactcttgagcgaagcagtgatgttttgtttaagagtttttttatatcttgttccggtttttgaggacgagtcaaagtatctcgatgaccgtcgttgagtagattagttgtaacatgttgatgacatttaaaacgaataacaatcaagctaattaagaggaggaagctaatggattactatcgtgttggcaccctagttaacacccacggcattcgtggtgaagtgaaagtcgttgtcgtgactgattttccagaagaacgctttaaagtagggcaacaattgaatttatttaaaaccccagatgaaacgactggcgggattactgtcaaaatcgcgaaggcccgtgagcaaaaggggctgtactttcttacctttgaagggctcgataacatcaatgatgtggagcgctataaggggtggacgatcaaagttcctgctgaagcattacatgccttaccagcgggtgagtactactatcaccagattgtcggcctacaagttgtgacgaccgctgacgagcctttagggactattaaagagattctgtcacctggtgcgaatgatgtttgggtggtcaaacgggatcatggtcagtctgacgtcttactacctaagattccccaggtcattaaagatgttgacttggatgcgggtgtggtgactgttgaactaatggaagggttgattgattaatgcaaatcgatattttaagcctgtttccagagatgtttgcggggccgcttcatgagtcgatgattggcaatgccattgaaaatgacgtcatcaatgttgatgtcactaattttcgggattttacgaccgacaagcataaccatgtggatgattatccgtatggtggtggtgcgggcatgttactccaaccacaaccaatttttgatgctttggccagcgttcaggaaaaacacccggcacccggtcgcgtgatcttattggatccggcgggagtccagttcaatcaacacgttgctgaagactttgctcaggaagaacacttgacctttatttgcggccactatgagggttatgatgagcggattcggtcattagtcaccgatgaagtctcgctcggtgattacgttttaactggtggtgaactgggtgcaatggtcatgattgatgcgacggtgcggctcttaccaggtgtgcttggtaattcggaatcggctccgggggattctttttcgagcggtctcctggaatacccacaatatacgcgtcctgctgattttcgtggtatgaaggtaccagatatcttactgagtggtgatcatggaaaaattgatgattggcgcttagaacaggcgctgaaacggacctatgaacggcgcccggacatgttgacggggctatcattgtcaggaaaagctaaacagatgttagcagatatcaaggcggatgagtcggaagtgtaggctatgccgttaattaggacaagttagtcgtgaagagttcaaaaaaacttgcgtgcccaccctcgaatatggtattctatttattggctattgtgcccattaacgatgttccgctgaccaggttgtcacgaatgtcggcgaaaggaagaaatacattatgcgtcaaaaccaattgatcgaaaagatcaccaatgaacaacttcgtacggacatccctgatttccgtgctggagatacagttcgtgttcatgcacgagttgttgaaggtactcgggaacggatccaattatttgaaggtgttgttatcaagcgccatggttccggtatcagcgaaacttatactgttcgtaagatcagtaacggtgttggtgtggaacggacattcccattacacacaccacgcgttgccgcaattgatgtcgttcgtcaaggtcgtgtacgtcgtgccaagttatactacttacgtaacttacatggtaaggctgctcggatcccagaacgtcgtcgtggctaaatcacaacgtcaacaatcatcggttgcagcttaggctgagctgatgatggaaagctagttaatcatttttaatgattaactagctttttttattggcgaagttagggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgccggttcttgataaagcttttaatattggtcattagctgaggactgatattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcacaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattttgatgtgaacggtcttaaagccattcttaaccatggaacgtttgccacaacgtgcgcaaacagtaaccggatacgttagcttcgcaagcacttgtaagcttccgttagtagcttcttgaacaactaaatcagtaatatttgggtctttaatttggagcagtactttagtagaatggtcttgggacatatctgacactcgctttcaattggttttggtcgacttgattgtagcacaggacgatatgtccttttgttgtacataaaaatagtgttgatggattttatccatcaacactaaatatcatagaccccgaagttagtgacacgctcaatcgtcaaatcatcgaccaatttaggtcggttcacaatgtgagcatgctgtgcttggatttataatttaacaatcttacgagatagctcgtaattcctaatttgaagtattatgatagtaatacgagtacgcgatgcttcttgggatgcgtcaattagctgaatatgaatcacttgatatcagactaaactgatttatttgaacagggttgtcgcgtacctgacgtgtataactagtgctaagctggcggccgggttaactaaacgggagattgctcaaagcgagcacgataaaataaaagagagttaggtgaaagccgatgtttggatgtacggggaaacatcaggtcgatgaacaggcgttattgagtcagttagttgacttcgttctcgacactagtcttaccgaccgtgaacgtaaaatcgggttgatggccaaagccgatttggagcatcatcgctattcaattgctgtgttaaataaattagtggttagttttcaaatggaggcgctacgcaacaagggcctttcgaaggctgcttcaaacttttatgatcagatttatccaatattagtcgcggccaaaccaatgggaacgaatttaggctatattgggatgcatagtacctatttagattagggtgtgtcagtgatgaagttactagcgaaaccagaccgtcttcagacggctgacgatggtttttgaacgtaagaggctggcgttcatcggaagtgtgttggtaacagcttaaatgagaacatcgtgcggcatgtccgtgcccctttgaatgaaacctattcagaggggctttttggtgtggaaaaacagttcatgatctgcgcgtcttaacaatattaggtgatgtggttggcgggcgataaaaattgtttggtgctgctaaatagctggtaaacgattttggccgtagaacaaatgctatacattgtttgataagtaccgaactgggatgtggatgagccagattcaaaataagtgtgtcaatatgttggttatatcagtattttaatgcagtgttatagcgtgaactgatactacaattaaataatctcaaaaataatttcgtctattttttgttatgcacttgttatttcaacttatttgaacgtatactaatgattgaaggggtcaattaggtgatagtttgatgattaacacaatcgtttcggcacggtacgaaacgcaccaaatattactcagctaaataacttgattgctccaggtacggttgaactttggaggcagaattatgcggaatcgtttaaataagttgggattggaaagtaagtctcactataagctttataaatcggggcggcgctgggtggctgctagtatcacagtattttcagttggcatcggtttgacttttagccaagttgaacaagtgaaagccgcaacgggtacgggggttgacacggccgacaatagcgctagcgttagttccgacatggcagaaccgagcaatgccgtcgtactaaaatcagctagtacggcgacagttactaagaccgcgactcaggatgcaaaagctgctactgatgtaacggccgcgactcaggatactaaagcgactactgattcaactggggcaacatcagcttccagtaatcgtcagtcgacagcagctacgaagccagctgccgaagtcggtactgcttcaagtcgcgctgactcaagtgctagcatatcaagtactgatggcgcaagtgctagtgcaccaagtgtcaccagtaaatctactgacacggaagccacatcagcatccgtaactaaaacggctactacgagtgctgacacagatgtgctaaacactgagacgacaagttcatcagtggcaaatgatctcactgatgctacgacagctagccaaacgcgtacggaaactgggaaaacagccagcatacctactgctgaagcaccgaccattacgactgcagtgacaagtcgggcactcccattgacgggtgcgctagcgagcaggtcagcaaacacgccggtcactaagtctacagtacaggcggtttcagctatcaccagtgaagctgaaacgaagccgaccgtatcgttagtaactacggggaccgtgtcgatggactatggcgaggcgtcgctggcggatctagaatctcatattagttctccagatgagacgccggctaacgacgtcgcctactacattcaagatgcagcgggcaattacttagaagatgtaaacggcaacaaggtcaatttgctatatgcactttttctggactctgctgatgtcaatgattacgttgatgttgtgtatacggatgaacatgggcaggtcacgaaatattccggagatacggacttttcaacgctcgaccaaattggtagttactcagtgacgatcaatgcagcgggtaaagctgggatgagccgggttatgcaagactataatgcttacgatacctcgaccagtgatttggatgactttgtcccaaccttttcgactggggcctccgattatacctttacaattaacattgtccctgtaaaaatcacagccaccactggtaagaatgggctaattatacttcggccttcacagttgtatacgggatcattgacaatgttgccggtagtcaccgttaaaaatgcaacaaagcaaaatatccttcaaattagtaacggcgaaatcggcgatgctaaaccaggcgtagccggcaaggtcggtcaacgtgttttaacgttggcagattttacttatacgtatcaaggcaccgaaactaacttgaccggtgcggacactggcaaatatgcaatcacccttaatgacgctggtcggaaggcagttcaagctgcgctgggggtcgaattatattctggatgatgcggcagttttcaccacgactggtgcggtgcaggctgctggtctcaggttaacgatagccaatgatacagtgacctataatggcaagcctcaggggacatccgtagctgtaacgactggaaccgtgtatgatcactttgattttactacgacgactgacacgaacgtcggtacctatgacaacctgacatacgcgttagcggatcccacgcaagcggcgattttggctaaaaactataccgttaccacgacggatgggacgttggtgatcacgccagcagatctgacagtcacggtcaaggatgataatgcagtttatgacggccgagcacatggcacgactgcaactgttactagcgggaccaattatgatcagttagcatttaccgcagttgcagcagatggcagtggtgcgacgacttatactacggtcggcacttatgcaatgactgggactacggcagccgataccagtaattataaaatttcgtatgtcaatggaacgctgacaattgatccagccaaagcaacaattacgattcccaacaagatttattggtcggatgggacgcaaaagaatttggcggcggtggttactgggacagttaatggtgagaccttaaagtatcgtgtgaccaacggcatgagtgcggttggaactaagacaattacggccactcctgatgctgatgattcggtgaataaaaactataccatttcagtcattcctggcaccttgacaattggtgatattgcggttaagtacctctacgaacatgtagatgctaatggtgagactcaggtagatgcttcggaaactggtacggcgacacatgctacggacgcaacggccacggactatttgacctacacgacggcagccaaacccaagacgggctatgtgttagcacccaatactggactagcctataatggcacgttaactgatcagggcggtaccgtgacgtatcgttatttggccaagactgaaacggcgatcgtaacgtattttgaccaaactgataacaaggttattaagacggaacccttacaaggagcgtacgggacaacggatgcgtatcggacggctgatacgattgccgcgtatgagaatgcgggctacgacctggtcgatgatgactatccaacagccggggtggtctatgatcaggacggcagtgttcaagagtaccaggttacgcttgttcataaatttgtaacacgcacgccagataatccgggtacgccaggtgagccgatcgaccccgataatccaaacggacccacatatccagtggggactgactttgaggatttaactgagcaagtcagtcaaaccattcagtatttatacaaggatggtcgcactgctaaaccgaacaatgttcaagcggttaattttggtcgtaacgtcacggtagatgaagttaatggcacagtcgtctacacagattggttgactgatgatggggccgtgactggtcgttttgaggccgttgattcacctttgattactggttatacggctgacccaaccagtgttgccggcaatcccggcgttgtatggcaggatgatgacacgacgattcctgtgacgtataccgtgaacacagagtatgcgatggtcacgtattttgaccaaactgataacaaggtcattaagacggaacccttacaaggagcgtacgggacaacggatgcgtatcggacagctgatacgattgccgcatatgagaatgcgggctatcaattgtaccgtgatgactatccaacagccggggtgatctatgaccatgacggcagtgttcaaaagtaccaggttacacttgttcataaatttgtaacacgcacgccagataatccgggtacgccaggcgagccgatcgaccccgataatccaaacggacccacatatccagtggggactgactttgaggatttaactgagcaagtcagtcaaaccattcagtatttatacaaggatggtcgcactgctaaaccgaacaatgttcaagcggttaattttagtcgtaacgtcacggtggatgaagttaatggcacagtcgtctacacggattggttgactgatgatgggaccatgactggtcgttttgaggccgttgattcaccttcgattactggttatacggctgacccaaccagtgttgcgggtcgtgatacggtgagtgggacggatctcagtccagatgtacaagtttattatcaggctaatcctgaaaaagccacggtgacctatgaagatacgacaacgggagcggtgctgacgacagatccggtaactggtgattatcagaccgtctcgaattatcggacagcagatcgaatcgctcagtaccttaatatgggctatgaactggtcagtgatgattatccaacatccggtgctgtgtttgataaagacggaagtactcaggcttatactgtcaaattgcaacataaactcctgccgctcaccccagagaacccgggtacgccaggcgagccgatcgaccccgataatccaaacggacccacatatccagcgggtacggctgtgcaagacttgattaagcaggttggtcaaaccattcactatcagtatcaggataaaagtactgctgccgacgctaatacgcaaacaatcactttcaagcgcagcgtgacggtcgatgaggttaacaataagctaacttataccgattggttgactggtacggcaacgactggtcattacatgccagtcgattcaccggaaattaagggctatgttgctgattcaacgcgtattgcgggtaatgacgaggtgcacaatgcggatgctgacacgaacatcgtggtcacgtatcaggctaagccagagaacgccacggtcacgtatgtagacgtcactacgggtaaaacgctcgctataaaaagcttgactggtgactatcagactacgtccagttaccggacggctgaaacgattgcgagctatgtcaagaatggctatcaactcgtacgtgataactatcccacttcaggggcggtgttcgacgtcgataattttgccaaaacttataccgtgacactgaagcataagttagccacggttacaccagagaatccgggtacgccgggccaaccaattgatccggacaatccagacggaccgaaatatccagtaggaacgaccgctcaagatctgacgaaacaagttagtcaaacgattaagtatcggtatcaaaatggggcttcggctggcactgacagcgttcaactgattacgtttaatcgggatgccacgattgatgaagttgagtctaccgtagtttatactgattggctggatgggacttcagctactggtcgttataccaccgtgacgtcacccgtcattactggctatacggctgataaaacacaggttgctggtcgtgattcagttgctaatacagattcagacacacaggtggtcgtcacctatgcggcaaaacctgaaaaagcaacggtcacttatgtggatgtcacgacgggtaaaacgctcgttacggccaatttgactggtgactatcggacacaatccaattatcggaccgctgaaaccattgcaggttatgttaaaaacggttatgaactggtacgtgataattatcccgtatcggggatgctgttcgatgtcgatgattttgctaaaacttataccgtgacactgaagcataagttagttacggttacaccagggaatccgggtacgccgggccaaccaattgatccagacaatccagacggaccgaagtatccagtaggaacgaccgcccaagatctgacgaaacaagtcagtcaaacgattaagtatcggtatcaaaatggggcttcggctggcactgacagcgttcaactgattacgtttaatcgggatgccacgattgatgaagttgagcctaccgtagtttatactgattggctggatgggacttcagctactggtcgttataccaccgtgacgtcacccgttattattggctatacggctgaccgggcgcgggtcacgggaaacgatgcagtaactagtgcggcgcaaccgaccaacattattgtgacgtatgcgattaacgcagaaaaggcgacggtcacctatgttgatgtcaccacggataaaacgctcgcgaccgtcagtttgactggcgattatcagacatcatccgattaccgcacggctaacacaattgctgattacagtaatcagggctacgtgcttgtccgcgatagctatccagtttcaggagctattttcaatgatgatggtgtcgttcacagctatctggttcagcttgcacatgtgacaactgcgacaaccgagaccaagacaatcacgcaaaccgtacattatcagagtacgactggcacgcagttgcacgatgatacggtcagagcgatgacattcactcgtactaaacgggttgatcaggtcaccggggacgtaacgtatagcaattggtcgactaatcaggcggatcacacttttgagcgcgtcgcggcgttcagtattccgggctatcatgcggtggtaacgggtactcaggcagtcatggttacgccagctagcgtggatgatgttcaaacgattcgttacgttaccgataggccttcaaccggtgagacaccaaaaacaccagtgaagacggtgacagttaataagtcggataaaattaagacgactgacacgccagataaagtcgcaacggtcaagacgccggataaggctcagaccgtcgcaacaacaactgctaaacaagctagcgtcaagcggtcagtggatctcaaacaagcacaggctgttgaacagcctgctcagacacgaccagccaatgtaaaaacggttaaactggcgaagacgactaaatccgttaagccaaccgcggctcatcaatcagccacccacaaacaagcgactttaccgcaaaccaatgatgatcggcaagctagtgttgcggcggaactacttggtttgactgcagcaaccttactagttggtgtgagtgcaattttgaagaaacgtcataattagccgttaaatggaggcgttaatatgactactttaatcgatatcacgggtcagaagtttggccgcttaacagtcattagacgttgtggaactgccaaaaatggcaatgccctctggttgtgtcagtgtcgctgtggcaatcagaccaaagctgattcgtacgcgttgcggcatgggcgagcaagaagctgtgggtgtttgacacgagaaagtcggtcgcagttaattcgacgtaatcccaaaacggctgccagtatggggcggttaagcaatctgaaaattcatgatcatcacactgatttaccgtcaaagattatgtctaagcgtaataagagtggtgtcatcggtgtcagctgggatagcaatactcaaaaatgggtggcgacatttttctacaaggggcgctacctgttacacaaaccgtttcagcactttgaggacgctgttcttgcccgccaggcgatggaaaaccgttatttaaataacaaagtgtaaattaaagttcttccttgagagggcctgatgccttgtcagagaagaactttttggcgttacagcaacggtaccagcttcttaattggacttagtggagttctttcagaattgtaagtaacaaaaaggcctaacatgggaatgccagcggataaattgtgcttgatttatggcgatgaaaattcctaaatgatttgcttgtatatgacaattattaaaaataagacggtccctgatcgaactagaatcataagtatcttgggggcaggtgatttaacggttcttggttgcaatatgtttttaatcaacagtctgatgaaacttgccctagaagttgaggttaactgatgcttctggatcggtgaaatcgttagtttcatgatggaactagtcattggcgacagaagcgttaatcaatgagcaacgtaccgctccggtttcgaattttcagacgattccggtataataaaccgtaactgatgactagggggataatcacatgattgaaattcacgaattaacgaaacgttatggggataagacagcattgaatcagcttactttaaccatcgcatcaggacaaatcttcggtttgctgggccacaatggggcgggtaaatcaacgacgatcaaaaacttagtcagtatcattaaaccgacgagtggcacggttacggtcgatggcttagaccttgaacagcaacgacaagccgtcaaagaaaagatctcttacgtaccggacacacccgatatttttcttcaactttcggcgatggaatattgggacttgatagctgccgcttaccagcaatcagaggaagccgttcagcaacggcgacagcagctggtgtcactgttcgatatgactgaacacgttgacgaacccatggctagttattcacacgggatgcggcaaaaagccattttgattggggcgttgcttcccgatccagatatttggattttagacgagccgctgcaagggttagacccccaagctgcttttgatttaaaaaatttgatgaaggcccatgctgccaaaggcaagacggtcattttttccacccacaatctggatacggcgcagcagttatgtgaccgattagcaattttgaagcaggggcaattgatttataccggttcggttgaacaattactagctcaacatccgcaacaatcacttgaggcgatatatttacaaatggccgggcggttgacggatgatcaccttgtcgatgcgctggagggtgagcatgatgcataaaagtcagttgcgtgttttgttggccgttaatcttaggttgttgaatccgcaactaacggatcggctacgtaaaaagggcgcttcggggccagccttgagtaagaagttgatgcggcaattttacttgaatgccttgatgtttcttggtatttatggtttgacgatgctggcctttgattttagcaagttgccaggcatgtttacgttctatgtggcgttatttatcttattgggagtttcacagagtatctccggtatttataacgtcttttttgccggcaatgatcttgttgaatacttaccgttacctttccgcaatcaagaaatttttatgagtaagattttggtcgtgatattcaacacggtaccctttaccattccgttacttttaatttttatcatgaccgcaacacgggcaggaatctttgtggtgttaggtgtgctgatggccgtcttgatgtatggcctaatactgagcttgttactgtgcttgtgcgccctaatagtttttggcttaaccaagctaactgtgtttcgcacccatcaaaaaatggtgatgaacgtcatgttaggccttaacgctgtcttagtgctagtcgggctctacttcatgaatcgcggctcatcatctgacaccggaacgcaggttgaccgcgcagcattacccctattgataccgatttttaaagttttcacgacgccgttgacaatgacgagtttgctaacctgggcgagtttaattgtcatctcgctgattttgttcgcactgactggacgatttgttttgacccacttggtggaacagcttacgcaagtcaacacagtgttattggcaacaccgcagcatcgacattcgcgacaacataaccgcaataaaattttgcgtacctaccagtttcagttactgaaagaacccagtttaaccttacaattattcacaaattcaatcctgctgccattgattttagtcgggaccgttctcttttcggggaccgcccctaattttagtcggctatcgctgaactggctcggtgtctggtttgtcagtgggatggctggtgcgatcatcaatgttaatcaaacctcattagtcggtaacctcatttcacttgataaaatgaactttgactttgtgcgtgcactgccaatcccaatgtcccgttacttacgacaaaagttttacttgggttattggtttcaggtcatgatcaatggtgtgatggttctagtggtgggtatcgctgggcgagcaccattagccctagatttggctctaatattgggcgttgcttgggggacgtacctagctgcccaacattactttaagcgtgattatcagctacggctgacgaattggactaatgtgacccaattatttaatcggggcggcggtaatcttggtttgatgcttaacttgttggcctgcagtgttgtgggcgtgctgacaattgtgatctatagtgtgctgattcagctgttcgcggcggcagctatgctgattaatatcattgtattagttggcgtcggaattatttctgctggtttggtctggcattactacaagactttttggcagcaacttgactaataagtgttaatttcacagtcacataatattaaattaagataaaagtgttgacaaattgctcattgagttttaatgttaatgacaacttaatattcgtccatgaaaccgatgaagtggagatcaagataatgatgcccgtaaagagagtcgccgttgctgagagtgcgatcgaacgcaaattattaaatggaccactgagggcgcgactaacgaacagttttgttctactacctcgcgacgatagggagccgtcaattcccgggaatgtgtttgcatttcgctaagctgggacccaagtctaacctgaatgggataatttggtgtccaaccaaggtggtaccgcggaaaaatccgtccttgactgtcattagtcatggacggatttttttgatagggggcagttcaatgcagcaacgatggcaattaaccacaactcaagtaaaactatcttattaatgaggagtggttcaatatgaatccaacataccaactttgattccttatcaggatcattatccctacgtaccagtgatggtcaaacgaccactcgccacatttgaccccattgcggttgctaaaattgtccaccagatggggaacggtttcgcgctgacgattgatcggcaccaacgatatagctattttagttttaaaccacagcgaagtctcacgggtcggcaactagccaagcaccaacgaccagctaatgagacactccaagccattctaaaccaatatcgaacaccacgaattcaaggattaccaccatttacggggggcttgatagggtacttcggctatgagtatgttcaacaatttgtacccaagttgcatttgaaatcaccagcaaccgcagatctcgatgacttaggtttattcttagttacgagtgtgctcgtctatgatcatcgacatcatgagcttgggttgacacagctgatttcaactgcggatttagcggcaacttacgccgtgactcaaacggctctaacgcaacagttagccgccattattgaacaattgcagcaaccaatagctttgccaccatttgacttacagcaaccattacacatgcaagcggatcaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtgacgaaggatggggaacaaatcgcgacgtatccattggccgggacgagacgccgtggtcgaacacctgccgaggatcagcagttggctcatgaattacaaaccagccctaaagagattgccgagcacaatatgttagttgatttgggacgtaacgatttaggacaagttgcaaagtttaaaagtgtccgagtgactaatttacggcgattaattcgttattcgcaagtcatgcacttagggtctcgggtggccgcagaagtggcgccgactactacagcactccaagtgcttgccgctacttttccagctgggacgttagctggcgcgcctaagattgaagcaatgaccctgattaatcattatgagcaggtgccgcggggtgtttatggtggttgttttggttacttggattgtaacggtaatttggacatggcgattggcatccggctggcctaccggatgaatgaacggttagtgattccagcgggtgcgggcattgttgctgacagtatcggcgctcaagaatttaaggagtgccagaataaacaacgagtgatcgttaatgcagtacaagacgcgaaaggacgagttaaagatggaattattaattgataactatgacagttttacttataacttgtatcaactaattggtcgtctgacgcccgatgtacgggtcattaaaaatgacgatttgacggttgctgcaatcaaggcattacaacctgaccatatcattttatcaccagggccggggacgccagcccacacgggagttagtccacaagtcgtgcaacaattagctggtcaggtccccatattggggatttgtatgggattagaagtgatggtcaccgcttttggcggttcactgcaaggcgcccagcatttagttcacgggcaagccacgttaatgcacgtgcagccgtcatcactatttaaagattgtccgatgcagttcatggcagcgcgctaccactcgttggtagctgatgcgggccgtttgcccgttaactttcgaatcattgggacaagcgatgatcaggaaatcatggcagtggaagatgtgggccgtcagctgtacggcgttcaatttcatccagaatcaatcatgacgccagccgccgttggtgagcaactgatccgtaattttttagcacttaaacattaagcagacgagagtggaggaatacttatgattgaaacagcgattgcacaactcactaaccaagaaaatctagactttacaatgagccaacaagtcattacggaaattatgaaaggtcaggccaccgacgcacagattgggagctttttgaccgccttagccatcaaaaaggcaactatcgatgaaattgctggtgcagcaactgcgatgcgttcccaggcgttaccttttaaagttaaacggcccacgctagaaatcgttgggacgggcggtgaccggtcgaattcgtttaatatttcgacgaccactgcgctagtggtcgccgctgcgggtgtaccagtgaccaagcacggcaatcgtgcggcgtcgtccaagagtggtgcggcggatgttttagaagcactcggtatcaaaatcgatctaacacctgctcagagtctagcattgctagagcggaccaattttgcctttatgtatgcgcgcgaatatcatcaggcgatgcgattcgtcgccccggcccggcaacaaatcaagattccaaccatttttaatatactgggtcccttagccaatccagctcatgctgagatgcaactactaggggtatatcggcaagctttgatggccccattagccgaagtgttgacgcgtttaggtgttaaacatgccatggtcgtgcatagccgggacggcttagatgaaatttcagcggcagcccctacggatgtgatcgtaattaatcatgggcagcaagtaacgcgaaccctgacgcctgaacagtttggactgacgcgttgtgaccatgcggctcttattggtggtagtgcccaagttaatgccgccatcacgcgagcagtactcgctggagaaccgggggcccctcgtgacgttgtgttgataaatgccgccgcggcgttgcatattgccaagccacagttggatctagcggccgcttttgagttggcccagcaaacaatcgatcaaggagcggccgcggctaagttggcccaattaattcagagtagtcaggcggtgatggcctcatgattttagatcaactcgtccaggcgagtcagcaacgggttcagaaggtgccagttagggagcgtgtgaagcgcattcaacaagctcgaaaaatgaccacccccgttttatcatttgaagcaatgctggcccagccgggcttacagcttattggtgaagttaagcgggcgtcaccttctaaggggctgattgcggctgagtttgactatttacagattgcgcaagactatgttgctgctgggatcgatgccatctcagtgttgaccgaaccccggtattttaaaggacagttgtcttacttacaagccattgtgcaaacggtctcggtacccacattacgtaaagattttattgtggctgctagtcagattgcgagtgctcgtattgctggtgctagtgcggttttattgattgttgctattttaacaccggttcaactgcaggctttcattacgttggctcatgagctgaatttaagtgcgctagttgaagtccatacaacggctgagattaagcaagcggtggcggctggggcccggattattggcattaataatcggaatttgaaagatttcagtgtcaattttgcaacgagctgtcagttacggcaagcagttccagctgagtgttatgtggtcgctgagtctggtattcaaacggccacacaggctcaacagttggccgctgctggctttgacgccatgctagttggcgaaacattgatgcgtgcaccagataaaggtcaagccgtcatgcaattgcgggcgggggtgcgtggatgactcaaatcaaaatttgtggcttaatgcgaccagcggatgtcgtgatggttaatcaagcgctcccagacgcaattgggatggtatttgcccccggtcgtcgacgacggattacgatggcgaccgcgcgccaactgtcacagcaattagatccgcgtatccggcgtgttggcgtgtttacaactaatcaattatcggaaattttagctctcgtgcaacagcacattattcaggtggtccagctacacgctaccgtcgatgatcctcggcttgcgtccttaatggccgcccatgtgccggtgattcaagcgatgacgccagcgaatgctacgcaatgtcaagcggattacttattattggataatgcccgtccaggtagtggacaggtgttggattggaatcaattacaatcacagcgtcccgtccggccgtttatcttggctggtggtttaacaccgacgaatatcgtaacggcaatcaacaaggtgtacccggcaatggtcgatgtggctagtggcgtcgagacggcgggcaataaagaccgtgaaaaaatcaatctgatggtccaacgggcgcaccaaacgggcgtgtcaacaccattattaacagaaattaggaggaattagtatgattaaaaatcaatcacaggcggggcgttacggcgactttggtggtcagtacgttccagaaacattaatgaccgagctacagcggttggatcgcgcctttcaacattaccgacaggacgcgcagtttcaagcagagttgactgacttgttgaataactatgcgaaccggccatcgttgttgtaccatgcacaacgattatcagatcaattaggtggtgctcagatttattttaaacgtgaggacttgaaccatacgggtgcgcacaagattaacaatgtcttggggcaggcactgttggcaaagaagatgggcaaaaagcgattgattgctgaaactggggctggacagcacggggtcgcaactgcaactattgctgctttgttcgggatggaatgcgacgtctttatgggtaagaaagacacggatcgtcaagcgctgaatgtttaccggatgcaactattaggggccaaggtccacccggtcacgactggttcaatggtgctaaaggatgcgatcaacgcggccttacaagagtggacgcggcgctgtgatgatacagcttatatcatgggctctgcaacgggaccacacccatttccaatgatggtacatgaatttcaaagtgtcatcagtgtagaagcccgacagcagatcctggaccaaacaggtcatttgccggatgccgtcgtggcttgtgtcgggggcggcagtaacgccattggaagttttgcggcttttcttgatgatacgtcagttgagttgattggctgtgaggcagcgggtaagggtgttcaaacgccgttgacggctgcgacgattgaacgtggtcggactggtatcttccatggcatgaagtcactctttttacaagataaagccggacaaattgccccggtctattcaatctcggctgggctggattacccgggcgtcggaccggaacacgcctacctggctgcgagtggccgggcgcaatatgtggggatcaccgatgaccaagcagtacaagcatttgaactgattgctaaggtcgaaggggtgatctgtgcgattgagagtgcccatgcggtcgcctacgtacaacaattagcaccaacgatgcgacgtgaccaaactattatttgtacgttgtccggtcgtggagataaagatgtggcggcaattgcaaagtatcgaggggtgacaattaatgactgatttaacaacaatttttaaaaatcataaggcgtttattgcttttgtagtggccggtgatcctaattttgaagcgacagttgaccaagttgttgcgttagcagaagcgagttgtgatctcgttgagattggcattccgttctcagaccctgtggctgatggtcccgaaattcaggccgctgatctccgtgcgtttgaccaacacatcacaccccaacgcgtttttgaattggtggtggcaattcgagagaagacaactattccactcgtgtttttaacctatgcgaacattgtttatcagtttggttatgctgcctttgcccagcagtgtcaaagtttgaatgtcgcaggcttgattattcccgacatgccactagaagcctctagtgaacttcgaccaaccttagaccactatggtattgctttgattccattgattgcgccaacgagtgatgatgcacgcatcgcagcgattgcccagcaggcgcggggcttcatttatgtcgtatcatcactaggtgtcacggggacccggcgacacatcacgactgatttagcaacactggtggcgaagattcgccatgcgactacgttacctgtcgcaattggttttggtatccatgagccagctcaggcccaggccatggcacaaattgcggacggggtcatcgttggtagtgcagtcgtgcatttgattgcgacgcaccaaccagcgacagcagtcttaagggactatacgcgacggatgcggcgcgcattggatggtcgcacggctgatacagttgactgatcttatttgttacgatgttgttgtgccgggctacttcgattaaatgctgggaaacgctcggataatgtgctagtctaaaaacagcttactgctttgtgggcgtcgttaataatagttgacgctaaccaagccagttaaattaatttacggagggctcaacatggcggatgtactgattattattgatatgcaagttggtgtctgtcgcgggtcccaaccggttaccaatttggcaaccgatattgtggtccagaaaacgcacgccaacgctttttatcacacggatttacaagcccaattgacggcgattggatgtcaaacacttgaaatctgtggtgcgcaagtcgagttttgtgtggatacgacggttaaaatggctcatgggttaggctaccacctcgaaatggttcgggggctgacgacaacgacggccaattccatgatgagtgcgcaacaaacgattgatttttatcaagatcggatttggaaccaccgtttcttgacgttggtaacagcatcgggccgtattgacgatttgttagaaaagacgggtgattagttgaaagcattattttttaatgattttggcgatgcgtcggtcctacagtacggtgaggtggcggacccaatcgttactgcaaatactgtattggttaaaacaacgtatatcgggctcaactttgccgacatttatcgtcgtcgtggtacctatcatctggaaaagcatcaaccgtacattgatggttatgaaggcgtgggaacagttgtggcagttggtaagcaagtggcgaattttaaacgcggtgatcgggtgttattcgttgacgtgccgtttgccaacgctagcctcgtcgcggttccagctgatcaggcgattaaagtaccacgggcaatcaatgatcagcaggtcgctagcattggattgcagggcatgactgcggagttcttagtccatgacttggcgcaaaaccaaccgcacgatcgagtcttgattcatggcatcagcggtggtgttgggcagctattaacgcaactgctcgtggccaatgaggtggctgtttatggtgtcgcgtcaacaccggcgaaagctgaattggcctatcaagctggcgcaaccaccgtttttatgcgccatgatccttgggacacgacccatcataatttttttgatacggtgtttgatggggtcggtaagacactaccagttagtctggcgactaccaagcaccgtgggcgggtcattttttatggcatggcagctggcaatccaccagtaattgatccagtcaagctaatgtccgaatccaagagtttgatgactggtgatttatgggattatttggacagcgcggttgctcgtcagtgccgtgccaatcaattgtttgatgatgtgctcacgcatcgcgtgacgatacgaccagcgacagtctattcattagcagaaggagccgttgcgcaccgggcccttgagaccgggcaagttgctggcaagattttgttgcgcccatgaagtacttgaatcgtatttgaaattaactggtttaatcgaatatcaccaaacggcatcgggcagtttttccgatgccgtttttgtggtggattagtgcgtcgtccagctagtgcaggctgaatcgagcaccagttagtcaattcaacaattgaattattaaaattcccagtcatgaccacggactgttacactaagtgctaaatcggtcaaatggaagtgtgatggtcatgattcaattagtacgttattcgacgacacggggagcactgaagcaaatacaacagtatcaactggttaatgtgatgtacacggcgacgccacaacaagttattcgtgcttgcaaatctgatttagaacgaacggccgttatgattatgaatggcaaccaattagtgggctttttctgtttgcatgttggtcaaggaccgctcagttacggtgaaacggaagtgaatacgattttgttgcgagccttatctgttgatgatcgctttaagcatcagcgggttgcgtctgacgcgcttgccgaattaccacgttatcttgccagtcattatccgatgattcaaacaatattattagcggtcaatcatgccaatcatgtggcgcaacatttatacctgacccatggtttcactgatacgcatcgccgcatagatggtcgattggggcgtcaatttatttatgaacgcccagtccattgtcccatggatttaaattttgattaaaatttgcttagttagttcagtcaatctagtatttggaatcttatcggaactaggtgcgatactttagaatcgtttgtgtcgttgcgagtgagattggatttaaacggaatctgattgaacggctcgttttacgattagttttctgctagattatgataatacgattagaaaaagtcgatcgtaaattaagctaatggaagtgatggcaatggtagcaattctttctctaatggttgtcatgggttttatgatgcttggcgagtgggtttccacgcgcagtcgggcctatgttccatccgtatttattacggcactcttatttctagttggtttttggacaattgttcccaaaaacattgtccccgctgcttcatttggcactgcctttattcaaattacccaagccgttttattggttcatatggggacgttgatggatctgaaattgttgttaaaacagtggcgcgcagttgtgattgccctgagtggcgtggttgggacagtggtgctcacgatgggaattggccgtcttttatttgattggcacacgatcgttgccagtgtgcccccgttgacgggggggttagtggctgcctttctgatgacagctggactcaaggcccaacatattaccgcactcgtggcgtttccggtggcaatgtttgtcatgcacagcatgctcggttatccgctaaccgcgtggatgctaaaacgggagagtcgccgactattgcaagtccgacatgtagacgtcacggtcgcgaccgctgattctgccaccagtgcgacagttcaaacaacggcgcaattaccagtgggcccgctaccaaccgtaccagcgaaggtgaaatcagttcaacctcaattacggcattggcaactaccggccgcttatgatacttcagcttttatgttatttaaagtcgctgctgtgactgggttggctgaatggactgcccagttagcccatggcacggttaatcagtacatcatttgtttagtgtttggtgttatcgcgcatcagttgggctttttagaagatgcggtgttggagaaagcgggcgtctttcactggctgatgtatggtctgctagcttatatttttgccaatctaaacattgttaaaatcagcatgttaagtggtattttgatcccgattgtaacgttgatcgttcttggtgttttagggatgtggattgcatctagcttattggcgcgaccgttgggatttagccgcgaaatggcttttgcaagtgcattgactgccttatttggtttccccgcggactatatcgtcacccatgaagtgaccgaaattatgggatcgactgcggaggaaaagcaatatttactagaccagatgttacctaaaatgttagtgggcggttttgcaaccgtctcagtggcgtcagtgattattgcgtcgatcttcttgaaaattttatagggggcttttcagatgatgacaacaactttagcagcttggatgacgaccttgcgccatcaattacacgcacacccagagttagcactgcaggaagtcgcgacgaccgctttaattaagcaaacattgactgagttgaacattcggttggtagactatccgggagaaactggggtggtggccgagattgggcatggtgcgccaatcatcgcgttgcgcgcggatattgatgcgctcccaatccaagaagccaatgagttatcctttaaatcaacgattcctggtcggatgcacgcttgtgggcatgattttcacacggccgctttattagggggagcgcgattattgaaagtgcatgaggcggatctcaatggtacggtgcgactgatctttcagcctgcggaggaaggacaccgcggtgccaaaatgatgattgataatggtgttctagcaggtgttcgtgcgattgcgggattccataatatgccgaatttaccagtcggcactttagcgatgaagtctggaccactcatggctagtaatgataattttgacgtcacaattctgggccagggcgcccatgcagcgatgcccgaagcaagtcatgatcccatcgtgacgcttggtgaattgatcagtaatttacagaccattcgtagccgaaatattgcgccagacgcagcactggtgctaacgattgctgccgtccaagcgggaacgacttttaacgtgattccaaatacggcgaatttacgaggcacgattcggaccttcaacacggctaaccgggatctagctaaagtacgtttttacgatattgtgcgtgcaactgccaagatgaatcagcaaaccgctacaattgattgggaccgaggaccaagctgtgtcaacaataacgcggcacttaccgctgtactatcacgtgttctgaaagatgattttgatattgtgcctgcccagctatgcaatgccgacgatgattttgcgttatatcaagaatgtattccaggattctatggattcttaggttcaggcggcaatgggaccttacatcaatcaaattaccgctgtgatgacgcaggcctaacctatggcgctcgcttccatgaattggcagctacggcactattaaagtgggttcgagcttgaattgaaagtggtcaatcgacaaagggaagacgcccgaccttgctaggaaactaacatggttgggcgcattttttatggaaagcttctgaatgataagtaacaagcgagtctggtcacaattatctgagtaactaaagtatttattgatacccgacttggtgcaatcagtaactggtgcgtgcagattattgttataatatatgtgtattagttttaatattattattttaatgatgaagggaacgaccgctgattgaattttggttgaggcggccaaaggtgattaggatgaaatcaacaattttcgaaaaagctggactagtatctgttcaggaagttgacaaaccaacattacaatctgatgatgatgtcattgtgcgcatcgtgcggacttgtgtttgtggttccgatttgtggtcatatgcgcatggtgatgacaaggctgcccattcgatcaacgaaggacatgaagctatcggaatcgttgaggcaattggctcggccattacgacggtcaagccaggcgactttgtcatcaccccatttacccatggctgtggtgagtgcgcggcttgtttggctggtttcgatggtacttgtgatcggcatccgggccacacaaattggtctaatggctttcaagcagaatacattcgcttcacttatggtaattgggcgttagttaagattcctggtcaacctagtgactatacggaagggatgctcaagtcattgttgacgctggcagacgtgatgccgactggttatcatgcggcacggtgtgcacacgttcaaaagggcgataaagtcgtggttattggtgacggtgccgttgggcaatgtgctgtgattgcagctaagttgcggggtgccgcacaaatcgtcttgatgagtcgccatgaagatcggcagcaaatggcactggcttctggcgcgaccgcggttgtcgctgaacgtggtgacgaaggcattgcgaaggtacgcgaaatccttggtggcggcgcggatgcggcgttggaatgtgtcggcaccgaagcggccattgaccaagctttaggtgttttgcataatgggggtcgcgtaggttatgtgggtgtgccacattataataaccggccacttgggtcaacctttgctcaaaatattgcggttgctggtggttccgcctccgttacgacttatgacaaacagttcttactcaaagcagttttggatggtaatattaatccgggccgggtatttacgcaaacgtatccattagccgacattaatcaggcttatcaagacatgcaaaatcgaaagacaattaaggctatgattaccattgattaagtgactaggtaactagtcgcttaaaagcaatcgataaaaagtcgtttcagtactgattcatcgtgctgaaacgacttttttgatggcaataattaatggtaaaaatcaatcaaacttagttgatttagactagtctttgcgttggtattagaaaaaagacatgcaaccagttgaaccgtgtcattaaagctagctggtcgcacgattgtagttggcttcgataattaaccgtttaaaagaacgcattttgctgtccgtgctgtcgccagcttgctatactgggtcaaaaatgaggtgagcgtaatgcgagtctttacttggatcgtgcgaacaattgtggctggtgccgttttgatgtgtgtcattatgattggtttggcaccgcaaacagttgtcacacattttaatagtgccggcttggctgattcattcggcagccgctggtggctagtgatgttaccactattagttgtggtcacgggtgaagtcatgattaagttagcccgtcaaaaacggcgcaagctcggactcttgcaactgccgacgctaacaggctttgaaggacagtgtttaggtgtcatggtgggtttcagcgtcctgttgtgggttatattgcaatcggaagtgcagggccggctagttagcgggggcattggcggatggtgattaggatgagaaattggcagcaggatgtttatgaattcgcctgaaattaatttcaagcgaattttgggtggtgtagctattttaaatacttagaccatcatggcttaatcaacagcgccaggcgtaatgagtgtgattttgcagttgtttgagttgattaatatcagctgttaatggcctgcgccaaaaaatggcatattatgttatgatgatgacgtgataaatcattaagccgttgcgattttctatgtaaactattgttattgaaaaacataggaggtcattgagatggcagttattttaattacgggtgcaagcagcggtattgggtttcagacagcgaaagacttagcacagcaaggtcacgttgtttacggtgcggcgcggcggttgaataaacttgaagcactagccccatacggcgttaagcccttgtcactagatataaccaatgagcagtcgcttagtcaggccgtagcaactttaattgccagtgaaggacgcattgatgttttgatcaacaatgcggggtatggctcatatggcgctgtggaggatgtttccattgatgaagccaggcaacagttcgaggttaatttatttgggatggctcggctgacacaattagttttaccgtatatgcgcgcgcaacgtgaaggacgcattatcaatacctcttccatgggtggacggttggtgagttatatgggcgcatggtatcacgcaaccaagtacgctgtcgaagcgtttagtgacgcattacgaatggagactaaagactttggcattaaagttgcaattattgaacctggtgggattaaaaccaactggggattcattgctgcggatcatttagaagcctcagcacgtcacagtgcatatcaaacacaagcgaccaaggctgccgcgggtatgcgccgacaatactcgtcgcgaatgatgtctgatccaaaaattatttctaaagctatttcgaaggcggtcaatcagaaacgaccacgggtgcgttatttaattggatttggggctaaaccgctggtacttgctaaggcgattttaccgactcgtgtttttgattttatcatgatgcatgccagttagtaggagtgattagtgtgaagattatggtttctgaacagtttcagtgttttatggcaagccttggcgttgatttaaatagcctgcttgaagctgccggtattaataaagtggtttggcaagaacaattaatgctttctgatgtggagtattggcagttaatgaacgaattcgacaaccaattgacggatgaaatgattcttagtttagggaatattactaacattaatacgtttatgccgtccttttttgcagcattagctgctaaaaatggtgaacaagcgattgcacgcatggcaaactataaatcattggcaggtccggttcatttagagatagtgaccaagccagatattgtcaatattcatattttgggaaatagtcttggcgtcgagttgccgcgtttcacgattatgacggaacaattgttgttaatcagcttgttacgagtaggtacgggaaaactcatcaagccaatttcagttggtagtaagtatccgtatggtgatcagattgatgccgtgatgggcattcgacctcaacaattggctgataattgcattcagtttcaagtcacggacttacagcgggcgtttatttcggccaataattcaatgtgggcatttttgcaaccagggttagaccaacaaaaactggctattgaacacaaccaatcattgctcgcgactgttcaagcactattgttgaagaaaattcctagtggttccttctcaattgacgagattgcaacaagtttgaatctcagtaaacgaaccttgcagcgtcatcttagtactttaagcaccacatttaatgatgaagtccaaattgcgcgtcgaaccctagtggtacccttgatgaaagattaatcgctaaacttgattgaaatcagctatttgttagggtattcagacccagagtctttttcgagagcttttaaaaaatggtttcatcagagtccatccgtttaccgccaacaatctctggggatgttcaaaaattaacaggcattgccgtttaggttaaaagttatgggcgttaaaatcttatggatgtgatggctttagactgatgggtaatcctttaaattaatagatcgtcataacaattgtgtttaagaatgctagttcttagatgcaattttttttgcgtgcatttaagctagtgacagttgaacagattgtatcactgcttactgaagtcaaaacttgttagcaatttgattataaactttatagtcaaattgctaaactgtgccagttcgttgacggattatgaccgcaaaaaatggatcgtcaagaaattttcgcaaaaaaataaagctcgattagagcccagcttaccgggatttggctactaaaaaatgtaacatactataaattaatctgctgaaatcaattgacaagatttggccggacgattaacttaatgccattcccaaacgccgtgaaaggagcgactaactatgagtgtgttagaagcaagtgaaattatgcaattaatccccaaccggtacccaattttattcatggaccgggtggatgaattaaatccgggtgaatcgatcgtggtgacgaaaaatgtcacgatcaatgagtcatttttccaagggcactttcccggtaacccggtcatgccgggcgtgttgattattgaagctttggcgcaagccgcgtcgattctgattttgaaatctgaaaagtttgctggtaagacggcttatcttggcgccattaaggatgccaagttccgcaaaattgtccgtcccggtgatgtcttgaagttgcatgtccaaatggtcaagcaacggtccaacatgggaacggtgagttgtcaggcgatggtcggtgacaaggcagcctgcacaactgatttaacctttatcgttggtgcaactgattcaaaatagaaaggtggtaatggcaattcggcgattgtcgtttgggaaagttttttaaaagcattgccgaattgtaaccaaccatgacaactaatttttcgattttagcgagtgctaaggcactgccgacgaccaaagtcacgaatcaagaactaacgcaattgatggcgacttctgatgattggatcaagcagcgaacgggaattcgttctcgccacgtcgcgaccgatgagacaacgacgagtttagctgtttcagttgcccagcagttgttgcagcaaagtcggctagcggcgacggcgattgatttgatcatcgtggcaaccatgtcaccggattatttgacaccggcgacggctcctcaagtacaggcagcgattggggctgaaaaagcaattgcctttgacatcaatgttgcctgtgcgggctttgtttatgggatgcagttggttcaccaatacttacaaccgggccagaccgctttgttaatcggtagcgagaccttgagtcggttagtagactggcatgatcgtagcactgccgttttatttggtgatggtgcgggtggtctattgattgctgctaagcctaatacggccactgggcactggctgggcggtcattacgcgacgtttggcgctgacgggcattatttaacggcgggacagcaacctcaggtgaatccgtggtcgacacggactgatggtgcagattctaaccgctgggcctttcagatgaatggtcggcgggtttatgactttgccactaagcaagtgccgcactcaattgagcaggcgttgatgcaggcacggctcgagtcgagtgatattaaagcatttgtgcttcatcaggccaacgcacgtattgttaagagcgttggtcaaaaattaaacttagctacggaacaattaccgatgaacattgcacagtatggcaatactgcggcagccagtgaaccgattctatttgccgaaatggttgcccaaaagcaagttcaacgtggtgacaagctggtgtttaccggttttggcggcgggttatccgtcggtagtgccgtaattgagtattaattgataactgaaatcaagcatttaaaattaatttaaaaattctggaggaatcaacaatgactaaaactgaaatttttgaccaaattaaaaagatgatcgtggaacaattagacgtggatgctgacaagattacgatgacaacgaactttaccgaagacttagcacttgatagtctggacgtttttgaagtgatcgataagatcgaagacgaatatgatatcgaaatcgaaacggatgacgcgttagccacggttggtgatttagttgattatgtggcgactcatcaagaaactagcgaggactaagttatgaaaacggcaatcttattcagtggtcaaggacaacagtttgccgatatgggggccgatctttatcaaacgttaccagcgtaccaagccacgattgacgaagctaatcaagtgttggactgggatctgcgggtaacttctgattggatcgatgatgctcaacggatgccggttgcaattacagcgatgaatatggggttatatcgtgctttaacagcgttgcttaatgagtgtccgaccgtgttagcaggattgagccttggcgagtatgccgcattgattgcagctggcgtcctgccatttgctgatggcttgaagttagttgccgatcgggctagatatatgcaacgagcgggattacagcatcccggggagatggtcgcggcgttgaaggtaacgccggcactggttgcagccgcttgtcaaagtgcccaagcagtgggggttgcgtatcccgctaattacaatctagctgatcaaattgttattggtggcgatgcagctggtattcaagctgcgcgaacctatttaaaaacacacggcgttaaacgggtggtcccattagacgttgcggtggcttcacacacgccgttaatggcagcagcgagtgaggcgttggcgcaacgattacgatttgttaatattgcagcaccccaaattccggtcatcagtaatacgaccgtgaccccctttagccaggcaactgtcaaggaaacgttggtaaaacagttagtatcgccaacgcactttgcggcctgcttacaacgaattgcgacatatgaggtcgatgagattattcaagttggaccggggcatagtttagcaacttttgccaaacaaacattgccgggggtaagggtttggtcaattgaagatgtgacagattggcagaattattgtcaggatactgaggaggtacgtgagcgtggatgaagtgattttagtcactggagctgctaagggtattggtttggcaacagtcaaacggctggcagctcagggggccagcgttattttaaacgttcatcatgaaattgaagcggccgattggcaagcattaacggctgaatatccaaggttgacgcaattagttggagatgtgagcgatgatcaaacggcggctgatttaattgagaccgtgatgacaaattttggtcgcttagatggactcgtgaataacgctggtgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaagcggctcggcgccaagtgcggtgtaatgcggtggccccaggaatgattacgacggccatgacggcacaattgaatgaccgcgtaacggcggctgccttaagtgatattccactcaaacgctttgggacgcccgacgaaattgcccaagcaattgactttttattgcaccaaccgtacttaacgggacaagtgctaacagttgacggtggcatgacgatataagatatgggaggttatccaatgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtctatacagtgcaagtgaagcgatggcgcaagccggactaaatgaagcaaatattgacccagaacgattaggcgttatttatggttcgggtatcggtggtttaacgacgattgaagcgcaagtgatcaagatgcacgacaagagtcccaaacgagtttcaccgttattcgtccctaattcaatcattaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcgttaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgcttgtgccaaacgtgcaatgcaacaagccgttgcggaagccggcattcagccgcgtgatgtggattacatcaatgctcatggaacagccacacatgcgaatgatagtgccgaagctcaagcaattagcgcgttgtttggtcaagatgtacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatgagtatgacggatacggaagcgatgaccgccctgatcaatcagtttaatcaatccagcgctcaagtcatggacgtcaagacgacaacctttgaactgcatttgaataaacaagctgaaactgctgagacaaattcagcgcgttcacagccggcagtgaccgactctacggtaccagtggtcaaaccgacgactgaagtggcgactcaatcgggaacaacgatggtcacggcgcccctagttggggtggcttacttagctgccgacccgaaacaggcgccgtttgttcaggtgggtgatcgtgtcaagtcaggggaaaccttgtgtgtaatcgaagcaatgaaaatgatcaacgaagtccctagcccagttagtgggttcgttaaagaagttttaattaagaatgcaactatggttgaatttgatgaaccattgtttgcaattgaggagacgaccgtttaatggaagttacggatttaattccccaacggtttccgctgcaattattagaccgtatcatagcggtccaaccaggtgtcagcgcaacagcggaaaaattagtcacgattaatgaatggttttttcagagtccgacactgaccggaagaacgatgattcggccagtattattagaaattttggctcaaacgggagttgtggctttactatcgatgccggagcatcatggtaataacgtcttttttggcggaattcggcaggctgattttaagacggatgtgcgcccaggtgaccggttagaagcgatggtaacgttaactaagttgcgtcgtcaaatcggaacaggccatggcgtgattacctgtgctggtcgtgaggttgttagtgctgatttaacctttgtaatgcaagcctgaaggaggtatggcgattgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgctgctaatttgaccgggtgtcaggcgattcatccaggctacggctttttatctgagaatgcggaatttgccaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatattgaggcggctatgaaagcggcccataccttaggttacccagttatgatcaaagccgctgctgggggtggcggtaaagggattcgcgctgttagcaatgatcaagatttagcgaaggcctttcgaacagctcagcaggaagctcaagcttcatacgatgatcatcggttgtacttagaaaaaatcattgccccggcgaagcatatcgaagtgcaggtattagccgatcaacaggggcatgttatttatctaccagagcgcgattgttcgctacaacggaatcatcaaaaagtgttagaggaaagtccatgtgcggtcatcacgactgctgaacggaccaaattgggacaattagtggctaacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtatgccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgccaaaatcattgttcacggtattaatcggaagatggtcagtcgcaagatgcatcgttgtttattggaattgaccatcgatggggttcaaacgaaccggaccttcttagcaggattagttgcagattcgactgttggccgtggtacctataccacagcttatatcgaacaagactttttgaaaggatggttaagtgatgcccaagcgcaagtttcaagcacccactgaacggcagttagctgttcgacgggataatatcccagacgcgttattgacgcgctgtccagtttgtcatgaagattgttatacccaagatctcggtgaattcaaggtatgtccccattgtgattatgggtttcgcttgcctgcttggcaacgtgttcaacaattgacggcgagttttgaagagcgggatgcggacctgagtgcgcccgtcagttttgatgaccctgcatatttagaaaagttgcagcgtgccaaagcagcctcacacttgaatgagagcgtattgactggtattgggacgttagcgacttatcaatttgggttaggtgtcatggaaactaaatttatgatggggagtttgggggcggcaaccggtgagaaaattacgcgattatttgaaacttgtacgacccaaaagcttcccgttgtgatggttactgcttctggcggggcgcgtatgcaagaaggcgctcgtgcattgatgcaaatggctaaggtgtccacggcggttgcaaatcaccgaaaagctggactgttgtatattacaattttaactgatccaaccactggtggtgtcacggctagttttgcgatgcagggtgacattatgttgagcgagccacgagcgctcattggattcgcgggtcggcgagtcattgaacaaaccattcaacagacaccacctgcggattttcaacgggcggaaaccttattagccaatggatggttagatcaaattgtaccccgaccagccttacggaaaacactacaacgattattaacaatcactcagggaggtcatcaggatgtctaaagtaacggcctatgaacaagttcaagcagcccgtgatgctagtaagattagcattcaaacgttgattgatggcttgacagaggatttttttgattgtcatggtgatcgtcaacgggcggatgatccagctgtaatcgccggcttagcaacaattgctcaacggcccgtcaccattattggtattcagaagggtcaaaacttggccgagaatcaagctcggcattttggctgtgcgacgcctagcggttatcgaaaagcattgcggttaatgcggcaagcagaacaattacggcagccggtcgtgaccttaatcaacacgccgggtgcctatccgggtgttgatgcggaatatgagggacaaggacgagcaattgctgactgtttgttagcaggattacaattgcgagtaccatttttgagtttgattgttggtgaaggtggcagtggtggtgcattagccttagcatgtggtgatcaagtctggatgttggcgaatagtacttactcggtgttatcgcctgaaggctatgccactattttatggaaagaatcgcaacgtgctgctgaagctgcggaaaaaatgcgcttgacgccgacagaattattggcagatgggattatcgatcggattattcctgaagtagcaaccgcagcagattgtcaaccgctgaaaacagccattgacgagacattaactgctttaacagcaaagtcggtggcggaactggttacgcaacgccaagcccgttatcggcaattttaaataagtgaggaatgataagtatggatggaattttatcgggtaagaccattgtggtcatgggtgtggccaatcagcgcagtattgcctgggggtgtaccgaggcattaattgcacagggggcccaggttatcttgacttaccaaaatgaccgtttgaagcaaagcttacaacggtttgttgcgccagatgtgccgttaattgcctgtgatgttgctgatgatgacaatgttgagcgggcatttgcaagcattaaacaacagtatggtgccatcgatgggattatccatgcgattgcttatgcggataaagcaaccttagaaggtgattttgtgaataccacgaaagctggatatgatttggcacaaaatattagtgcgtattcgctgattgcagttgcccgagcagctcggccaatgctgaaaccaggagccagtctcgtaacgttgacgtattttggatcagagcgagccgtaccaaattataatatgatgggggttgctaaggccgcgttggaagcaaatgtgcgttacttggcgcgtgaccttggaccacaacaagtccgcgtgaatgcaatttcagccggagcagtcaaaacgttggcggtaacgggtattcatgagcatcagcaattattaaaattatctcgcagtatgacagttgatggagaaccggtaaaaacgcgtgagatcggcaacgtggctgcctttttattaagcaatctatcgactggaatgaccggggacgtggtatacgtggataaaggggtccacttaagttaatgccaatcactcaagttgtctttaaacggcagtggcttcagatgccggtcgatgtttctaaaaaaatgcggcgggtcactcagcgaaccgtgagtcgccaattaattcagcaagtgttatcggtaccattagcttatcatcgattgggacagccctattttccaagtcatcctcgattaggtgttagtgttagtcacacgcaccagttagtgatggtggcggtcggtccgggacctctggggattgatgttgaacaggtccgtccatatgatgtgactgccattcggcgagcctttacatcggcggaatggcagctattacaggctttatcggtgcaagatcgttatcggttagggtggcaactttggacggctaaagaagcggtattaaagttagtgggctgtggcttgacccatgcgccccgccgtgtcgaggttcttgatttacaacgtggactagcgtgctatcaaacacagttataccagttgatgccgttagaattgcctgcgacccacgagggatttttggctcgtcccttgtcggttggctgattggagcgcatggttggtattaactttagtacgctcttttttaagtttagtgaacaatggccactggattttattatcggccaactggttgacctgctattgcaagccttctacgtgctgactaaaagcagttctgagcaagccataattgtgggctcagaactgctttttaatttatccttcaataatttatctataataatggcaatgcaaaattcatccataaccatgaaatcggcatgataacgaccatcatcggaatcatatcggcggtcggaaacatcttgacggcaataatgcgaaagccgctggcaaccattaaaataccaccgaccgctttgaaatctagaatcatgtcaggagtggtcaagggaaagactaggtgagcgactaagaataaagcagtcaggatgattagttggggaacagcaattaaggaaacaactaaccctaagttagcaccgaaaattaccgcagcaaagaagtccagaattgatttggaaatcaaaattgtggcgtcgccgttcatcccttcagttaaagtcccataaataccagttccactggcacaaaataatacgattaccgtgaccattgtctgttcaaaggcctgtttctcaaaagttgctggtgctttgacaaaccgtgaaatgaaacgttgcatcgcggcagcgccgtgattgattgcagttcccaaatggcaaagcaatccaatacctgttccgataataacggcaaagatgaccgccgctagattttttaatggtgcaatcgcgtaaatccccatacacatggaacagatcccaaaggacatattcagcccatcttttaaacgttgtgacattcgtttgccggtcaatgcgcccacaatacccccgaaaaagatcgcacacacgttagtaataattccaattggcacgcaagccctcctcaatatttaattgataaaaacaacagctattagtttagagcttgtttcggataagaacaattctgaatatgtggtaaactattctaaataggaatagttagaagagggttaattatggaaacacggaaattggcagtgtttgttgaccttgccacgacccagaactatagtcgcagtgctgaacgcatgtttttgtcacagtcgaccatttcaaagtacattatggctttagagcgcgattggcaggtccaattatttgaacgtgcgcatcggcaagtcacgttaacacggattgggcaacaattattgccacgggcccaagcaattctgcgcgaagagcgtcagttacaacaagttctggccgctaataccgctcataatgcgcagtcgctggttgttcagggactaccatctttagcacaataccaggcttttcatattatcacggcatttacgaagcggtatccggaagtgaaattacaatttagtgaggcgagtgtcgatcggttagcgcatgcactggatcatacgaatgtcgacattgtatttacacggattttcggggatcaacccaataattatgacgttttattgaatgagaccgatcagtttgtggtccttgttccgaaagacgatccgttggcgcaacaagctgagattagtctgtcgatgctggcacatgaatcaattttattattgaaagataccatcggtgaagataacccgttgttttcggcatttcaaaaaatgcatacgccacagatggtctatgatggtcaacgaattgatctcattttagaaatgctgaatcagggtgatggtgtctcggttgtcatggcgcggtcatttgatctcactggttttgacaacattaaagcaattccactgacgcctactattcgcagtcagatggctttcatgaaacgtccagataatcacgctgccgtggttgctaaattttgggcgtttgcgacgaagtatagccaatcactttcagattaattgtggcggctgatcacattctaacgatgtgtcttgaatcggaatcaaagccgacgatgacataaggataaaagcagtcggtttcggtggtcgtagcaggaaggacgtgtccgaacaacaaccgagctagttagtctgttttaatcacattgtaggtcgtttgcagtgatataaataaaaataattaaagatgacggggtgcagacatggaaccaattcatatttcacagactttatcaattaccaatcaccgtgtgttttcagctgatttgaatgagcacgacacggtttttggcggaaaaatcttggcgactatcgatgataattcatcgattgccgcatcgcgagtggctcgaattgagacggtgaccgtgtcagtcgatcaggtcaattttttattgccgtttcggttacaagactcaatgtgtgcggaatcttacgtttcgggcgttggtcaccgctcaatcgaggtatttactaaaatcattggtgaacacttgaagaccggcgaacggtttttgggattgacttgcttttcaacgttcgtggtgacggaccgtaatattgaattaccactgttagtcgctgataaaccagaatacacgtttgttgctcagggctatcaagagcggcaggccgcccggttagccaaactaaagcgccagcaagactttaatgcgcacattagcgttgaattgccgtggtgaatcgatttaaattgacaattttggtgagacttgttaaattgtaattatcaaatataggaggggtgttttatgtcgggcattcgttagggtgttgttgagcgaaaaaagtgggttggacccgcttagtttcgtgtaccctaatgtgacgaatggcctggcagatagacatgccggacggtttttgcgcacagttgggataagactgggcgcatttttaattcgcagagcgttagggtaagtcactttgcgaaaggattataaaaattgacaattaatttaattaaatatggattgacgacggcggttcaagccgacttgactaaggaaaacggtcaaatacttggccggattatcggccaacatcgtgattggtaccaagtcatcacgacggctggggaacgttcagcacaagttacgggaaaactggcttatgaagcggccagtcccgcggcatttccggcggttggggattgggtgtgcctatcttcatccgctgataatcaggcgcagattgaagcaatcgcgccacggcagagtgtcttggcgcgcggtgccgtgaaccgccaagacggccaaatcattgcgacaaatattaataccatctttatctgcatgtcattgaacgcggattttaatgtgcggcggttagaacgttacctgacgattgcgtgggatagcggtgcacttccggtcattgtcttaaccaaggcggatctctgcacggatctagccactaagttacgggctgtggcggatgtcagtgtcggcgtaccaacgatcacttgttcggtcgaaacgggtcagggtttggatgaattgcaaccatacctaacgactggtcaaacggtggccttcgtgggctcttcgggtgtcggtaagtcgactttgattaaccgattgttgggccaggatatcttggcgacgaaatcgattcgtacagatgatgacaaagggcggcacacaacgacgagtcggcaattaataccgctaccaacgggcgcctgtgtcattgatacaccaggaatgcgtgagttacaaatcttcatgggtgatttaaatcaaactttcgcggaaattgccgcattggcgacacagtgtaagtttaatgattgtacccatactagcgagcctggttgtgcggtacgggcagcagttgaggtgggcacggtaacgtctgaacggttacaaagctatcaaaaattacaacgtgaaatgagctatcaaggactcaattcacgccagttggagcaggctaaaattcagcggatgttcggtggcaaacaagcgatgaagcgtgttaaacaacgttaccatcgcgactgagttgataagtaaattaaagaagctactaaacgggatgtcggcaacggcaccccgttttatttaggacctactttcgttatcgcgtagagtgaaccgagtgacctgttgagcgagataggccggtgtttcaaccatcccattctgttgccaatgaacgagcatattgatgaccgcaccagaaaaataagctgtgtagtacggttggcgaagcgcggtattgcttgaaccgataatacggtcttgtttaatgagtaatgcaaagacggcttcgaaactttgaataaaaatctgggttttttcgtttttgatcaataacgcatttgtcgctgccatttgttgcatgagagtgaaatattgagtcatcaatacctgcaatttaacctttgattgtcgcggtaattggcgcagatattgaaggatagtctgtttttgataggccaaaataatctgatcgaagttggcgaaattacggtaaaaataggtgcgagaaacctgagcgtgctgacaaagttctgtgattgaaatacgactgagtggtttttgcgacataagctgtagtaaggccgcataaaccgcagttaaattttggcgttttcgtgtttgtgggttcattggttacaacatctccttttttgtaacgtaagtatttatttatgaccattttaccagatatactcccattaacttaacgggaggcgattatgatgaaaaaatcgacgaaagtaattgcaatgatgatgattggcatttttctatgtatgcttgatacgacggttatgaatattgcgttgccagcaattcagacgggactaaatactgatttgacgcacctgtcgtgggcactgaatatttacaccgtcctgtttgctagtctggcgattccactcggtcggttagcggatgtctggggacgtgggcggatgtacttgattggactcgggctctttggtattggttcactaacttctggattgagtctcagtgtcgggctgctgattactggccgagcgattcaaagtattggtgcggccatcgtcttcccggctagtatgacgattggtattcagagtgttgcactcagcaggcgtacgggggtcattacaagcttgggcgtgatgcaagggctagccgcagcgttaggaccaaccattggtggtgcggtcactcaattttgggggtggcggggaattttcctgattaacgtgcctttagttgccgtcgcgttgtgtggttgcatcgcctggctatcatggcggcaccctagtcatggtcaagtaaaactagacctcggtgggagtgccttagtgatgacgaccttattggcattgacgttggtcctggttaaaggtaatgactggggatggacgagtcgcgtagtcctgagcctgggcgtcactagtgcgctaacattgattgcctttgtctggatggaggcccacgtctcagcgccgatggtcccattagccctatttaaagaccgacagtttaacggtgcggcgttagcgaccgtgttatcaggggtctttatggtgggactattagtcttgatgccgagtttcttcacgaaagttcaaagtaagacggaattgatggcggcgattatgattacgcccgcttcaatgatgatttttattttttcaccaatcagtggtttcttgttagcaaagcttggtgcgcggcgcgtgatctttagtggtagtctcgcaatagctacgggttatggggtacttagcctgatgagtcctagtcagtactggcagtttgcattggcggcgttattggttggtgcgggctacggcacgattattgggccaattacggtattagcggccggtgattttaccggtgagttactgacagcgtcacaaagtgtgattggcgtgtttcggcaaattggcacatcgttggccgtagccatttttgtgtcagctttagccgctaatttgacaacggctaagacacagatacgaacgtatgcaacgacgacggtcactactttatcaattcctaagcaagccaaacgtgatacgttacgcgtggttgaccaccaattagcaactgagcaaaccgcgcaaacggtccacgagccaatcacggcggctaaggcccgccggttggttgctgccaattatatgcaagtgttaaaagcacggtcattgcagtccgctccagtgcgtatcaaagctcaaattcatcagcaggtggcccaaaaggttcacagtcaagttaaacacactaatcatcgaataaggactgctgcatcagcgattaaggccaaaaccaaaattgagttaactgctgcgtttatgcgcccctaccaagtcgcttggccattcacactattgctagtgatgacgacctggtgttttgcgggacgggagcggaaaagtggcaagccgagttaagtcacgttgatggggatggacttcaggcacgtttgaatagctgagccgggagggccgcgaaggtgattgccaccactgactttggaacttgccatcgaacttagatttgcgagcatgtgaggcgcttatgctataataagggccaaagggggtagtcttgatgaaagaaaaacaagtgtttcatatcaatggctatattggtctagtgttagcgatcgcatttgtgttagttggcggttggctggtttgggccggtgcgactggcgatcattttgcgagtatctttttgggcgcattgctaattattattgcggcctttggggctagttcgctaacaattgtgggccccaacgaggcgcgcgtgttaacattttttggtaagtatatcgggacaattcgtgattcagggctgtttatgaccgttccgttaaccagtaagttttccatttcactgcgggttcgcaactttaacagtgccattttaaaagttaatgacctccggggaaatcccgtggaaattgcggccgttatcgtgtttaaagttgttgataccagtatggcactctttgcagtggatgattatgaacaatttgttgagattcaaagtgaatcagcggtgcggcacgtggcctctgaatatccatatgatacgtttgatgacgacaagaagattacgctgcggagtaatccaaccgaagtttctgaccggttaacggaagaacttcaagaacggctaaatgttgcgggggtcgagatcgttgagacacgcttaacgcatctcgcatacgcgactgaaatcgccagtgcgatgttacaacgccaacaatcttcggcaattctatctgctcgcaaggtcattgtggaaggggccgtttcaattacggaagacacgatcgcccgtttagagaaagatacggggatgcagctatcagacgataagaaactgcaactgatcaataacatgatggtcaccattatttcggagcggggtactcagccaattgtgaatacttcggaagttaagtaggaacgttgatataacaagatttataactgcattttttaaacgcatcaccactataaaagttggtgatgcgtttttgtggtgaagtcggtggtgaagaaatcaagaatttaagctaaattatagaattaatcttgtaaaaacctgtttaatttgctaactgtttcgtccttaatctttggcgtaatttctggtagttcccaaatcagaatgtcccattaggtctttaatatcttctaaactaaccctagatttgcgaaagcgaactccgtaagtatgtctgcaaccgtgaacgtttaaatgctgaagctcagcccgctctgaaattcgtgccattgcaatttgaacgctggtctgactaatagggtatccattaaggcgttccttgcttaagggtctctgtttgctatttgttagctaagtttatgcattgtttttgccataatccaatgaatgaattttaaattactgatgaagcttacaaacattatgattacaacgataatccattcccatagcgaagcttttgttaatgtggttaagccgtataagtaaacgattattatgggtaattcaatagttgctgttatggctccaggaacataggtacgtttattaaagacaaaaactaagtgcatgatcaaatgaaaaagatacggtaaagttgcagtggcaactagtaatggtgagtccatgatgtaggcgactgttgcaagcaataagtacatacaaaattcctcccagattccagcggctaaaatatctgagcgattcactccaccaaacagaacatgtccgtgaattttgggattatgatcttttaaccaatatgggacaaatactaactcttcaaagtcatgaaacataaatatcaacggtaatatccaataagaactaaaattatgcattttattgccctcctgctagtattatattatgttgatgcaaatttttgaatataatgaagccatgtgccactgaaaggggtttttgtgccatgtctcggacaatgattattgaagaatctaaagatgcttttattgaggccttgtttcaactgctggcaaacgaatcatttgaacatattacagtcaaacagttgacgttagaatcgggttattcaaaaagaacttattatcgatacttcagaacaaaaacaaaaattttagatatagcattttgtaaatatctatctaactatcatgattacttactaggatcttccattacaccggatactatccctaagcatttgcttgaatttatttggccccaccgtgacaagatagaattgctagctagaaacgatctcttagttcctttgctaacaagacatattcaaaccattgtagcgcttcttctgagtgtaaacgtcccttggcgaaaaaacggttcgaatgaccagcattatgagtacatgctaacgtattcaattggtgggttcggcgttctgctggatacgctttttaagaagagtactcccttatccccgggtcaaattagcaaggctttgagcagagcattaaatgagattgctatccaagttaatattaaatagatgaaaaacatcatacgttcagggtctataatcctcaatcgcccctcaagtacgttattttttagtttgttgtgaaatttacgctttcattgtataactgttataatagcgaaaattgatttttaactacagaaattgtaattttagacaaaataagaaaaaactgcactagccttaattggccggtgcgctttttattgtccgtcatttcgctctttcagtagtttatgacgatttgaaatcaggcttatcgatttttcttacaactataacattacacgcgtatacgtgtacgatcgatctttaatttaaattcttttgttacaaaaaaatgtccacgcgggttagacgtgagcatagatagttttcgggtgcagaaagtcaagaaaaaagagaaatttagaccgggtgagggtccaacagtaatcagttacacaagttgaatcatgtttcatttttttattttatgttttttgagttatttcaataacgtgaaagaatatttatcaagaggtcactcagtaaaattccgtaatgacgccgtaacgattccagtaacgaatataaattgagcaaagaacaaatgtggttaaaatcctgtttagagcttgttataaagaacataaaacaacgaaaatctataggcgtgtatatttcggaacggggtactcagcccattgtgaatacttcggaagtcaagtaggaacgttgatatagcaacaatcaaagttgtagcagtaacataaaaggcgctcatttgctgagcgccttttatactacagttaagttcaagcagtaacaaaaattgacatcatgacccgctaatcttttaaaaagatgctccttttggggatgccttcaatgggtcaaatcgtagctggaacactctttatgaattgctagggttactttccaacaccgctcatggcaattaggccataccaaccgtgggcaaacattttatttgtagaagttgttaagttggcaattaactgatcttgttcagatgagaaatggtattttttagcgaaagccatcacttgaagttgactgattaattcattgattgcgtcgggtatttgttgataacgcttagtaactgaatctggttggttgatagttgcgtaggcttggctaattaattttctgatttcaactttttcaattggaactgaagtgtttagctgttctaaaagctgattaacagttgttaaacgcgctaatttctgttgctgtttcatcattgaatcccccagtgtagtgtttagtttgaataaatgaattagttataaatgatatagacttcacgttactactatataggctaacatacaaatgaatactgtactgcatcagcaatttagtttttatgttaatttagttgtccgtttagataggctttgccaataataataattaaccctattatgattaataataaactaacataattaagtggacgacttttgctctgatagtgagtgaaccagccatacttgatccgggtgttaaagacattgatgatgaggccaatgccagtgatgaggccgccaattgcgataatgaaatccatttgtaatacctccatttagtttaagcaatttagatgtaatgactgcagtaaatattgatgctgaacagtcttgatgtctggcaacaggcattagtttttggtatttaaaaaataggtcattctgaatttaatatcagtagtttaagattatctatataaatattatgaacagcataattttcagtataaataaaactgacaatcattgctattattagaaataccgtttgcggttcaatacaggttcagtgaaataaagacaatcaatcttccagaaaatcaaattcaggtatataatgtttcatacacaaaacattatataggagactgttatgctagacaaaatcatttataaaaacttatttagtaaagcgttcgatattactattgaagtcacttattgggatgggcaaattgaacggtatggtaccggcatgccagctgttaaagttcgattaaataaagaaatcccaattaagttattaactaatcagccaacattggttttaggtgaagcatacatgaatggggatattgaagtagatgggagcattcaggaactaattgcctctgcttaccgccaaaaagacagttttttgacacataattcatttttgaaacacttaccaaaaatatcacattctgaaaaaagcagcacaaaagatattcaaagtcattatgatatcggcaatgatttttataaactatggttagatgataccatgacctactcctgtgcgtactttgaacatgacgatgatactttaaaacaggcacaactcaataaagtgagatatattttaaataagctggcaacccagcctggtaaaagattattggatgttgggagtggttggggaacattattatttatggccgcggatgagtttgggttagatgcaacgggtattactttaagtcaagaacagtatgattatacacaagcgcaaatcaagcaacgtcatttggaggaaaaagtgcatgtgcagttaaaggactatcgagaagtcaatggccaatttgattatgtcacctcggtaggtatgtttgaacatgttggtaaagaaaatctagggttgtactttaataaaattcaagcgttcttagttccgggaggccgagctttaattcatggcattacaggtcaacatgaaggtgccggcgttgatccatttattaaccaatatattttcccagggggctatatcccaaatgttgctgagaatctcaaacatattatggctgctaagttacaattttcagacattgagcccttgcggcgccattaccaaaagacgttagaaatctggtatcacaattatcagcaagtcgaacaacaggtcgtcaaaagttatggtgaacgatttgaccgcatgtggcaattatatttacaggcatgtgcagctgcttttgaggccggaaatatcgatgttattcaatatctattagtgaaagcgccgagtggaactggccttccaatgactcgccattatatttatgattgatcttgtcggttctgcggtagtcgtatcgaaatatagctccacaataaatatgtagtttcattgatccctcataaaaacatgagggattttttattatggatctggaatgatagacaagggcaaccattccagacttgttcagtattaggctggaatcgataggcatagaaaagatttcggacctctgtgcatcttggtggctatcctgttgtcagggcgttatagtgacaattgaggaggggatcttatgttgagcaccaagaagaatcatgtattacggtacttatttattatagttggtatgatgatcgcgtttttaggttgtggcgtgattcaagtttcagcacatggctttgtgacgaatccgggtggcagagcttatctggggagtacttggtatccaggtgggcctttgaataccaatattggttcggttatgtatgaaccacagagtattgaagcgccccaaaatacatttattgatggcaaaattgccagtgccggtattgctaactttgcaccactagacgagcaaaatgccaaacggtggtataagacacctgtgaaggccggcaatcttagtgtgacctggcagttaactgctcgccataaaactagcacttgggattactatattaccaagcctggctggaatccaaacgcaccacttaagtttagtgatttcaagaagatagctagttataatgacaatggtgccattcctagtgaatttgtaacccatcaagtcaatatttctgctaatgaaaaaggctatcaagtgttactaagtgtttggaatatagcggatactggtaatgcgttctatcaagtctcagatattgacgtacagtaattagatgaggcctaaatttactttgaggtgattttagactataaaagttgtctttgagatatcgtaaaggtcttactggcgtttattggctagtaagacctttttaaatgtgctttaaggattcatagaagcgaatggcgatgaccggtctttactgattagtgaagaacaggttgctattgtaaattagtggtaataattaagcggatgccgggaatcagatttacgattacagcttggcagctggcattttagcattaaggagtacgcgcaggagcatcccctcaatgcaagttagttgaaccaaggtggctcaaacttgtgattcaataggtgactgtcagttgcgctcatgtgactacagtaccaagtcgttagtgatccatccgggtaatttcaggctcagttatcagatactcgttgatatgggcgagaaagttttgaaagtgcggcgtttcattgtgaaaattaacggcggcttggtcttgccagtgctcaataatctcgtagtcactgtcatgatccagttgcttgaagtggccatagaaaccgttgccgggttcttgtgaagaattgaccactagctcatgaataaaggcttcatactgagtggttaactcaggcttgacgtgtagtgcgacattaatgactttcattgaatactccccctgttgttcgtgcttgcggactgataacctactcggtgatgccgataaagccgccaaagcattgaagcgactagtcgtcaccatcttactgtaataatcttacaaaaagaatattctgattatatcgtacgagaccaggattgtacaatgaaaacaggtatcaattatgcaactgcatctgattaattactcatttatcaaggccgattggtgcgggcgaaaatttaaacgaattaggcggtatatcggggtaccagtgacctgtacgattatcattttttagtaataataaccagcagatgtatatttatggatttgtcattcaagacgcggtatattaacaatgttaaatactaattcctagggggtggacaataatgagtaaagtttatacggatgtgttcaacatcaagcatacggattgtacggtagtcgatactatcaacgaatttagtcgaatttttattatccaggataaacacggctcacggtttacgtgtctcaaagatgatgcccgcccagctaaaaagggtagtggccattggacgagtgccagtccggaagatgcgccacaagattacgctgtgccgtatcgttcaagaaaacggcaacgtagaacgctttaaatagttgattggtaacacggggcctggcggtgacaacaccagttaagccgtgttaaaactttaatacaataagataacggtcccatcagtaacaatgactgatgggaccgttatttgaattgcgattatatttaatttaataatgcgacgcctaatgtcaaataagttgcaaaacagatccataccaagtaggggaccatcaaaattgcggctagccgactactgcgatagaactgtaatatgcaaagtaagacgactaaatcaagcacaatgataatgactaagccccaccaataagccgactggctgaaaaagatgatgctccaaataaagtttagtaacagctggataccaaacagggtggcgtccatgaggcggtcacggtgtgtcgtagcctgctggaaaactaagtaaccagcaatcgcaatcagcgcatataggatcggccaaacgatgccaaagaggccatctggtggtgatagtactggcaagttgagcccattgtaaacggccttaatgtctcccgcgagccatgccgacagactaccgattgcttcgacgaccacaatgaaaatgagcagatgaagccaattgaatttagggcgttctttgatcattgatttttccctccttctattagtcgtctaatcagggtcgtcaattgtgttaatgactgtcacgttgacttccgctttttgtacgacgtacgcggttgttgagcctagcaaaattcgagaaaccgcgttggtgccggatttgcccatgacgattagatcaatcgcatattttttgggaatatcagttgcaatgctagcttttggtgaactattaacttgaattggtagggattcgacttgtgctgccgaagccatttgctgaccacgatccagaatgtcctgactattatcttttgcgacttttagaaggtttgtatatagcgttcccccgtaagctgcaggactatacgcattcaggcgtgtaatatcaataacattgaccagaaataatttagatttaaacgtctgggctagtttgaccgcgtgttttaaagccatgtaggcattatcagagccatcaagcgggactagaatattttgatacatcctcaggacctcctaaatgaaatgatgttatttattatattaatgataacattcacataattagtgcgtctattaatatgattaactgccagcgctcagtcacaaaaggcgcaaccattatgggccgcttagccaataaaagttgcgcctagttaaattattgccaacgatttgagcgtgacggcaacaccattaagatgaagaaccaaatggtcccaattattggaactaagtcaattaaaatccaccatgcagtgtgatcactgtcatgcaatcgccgaaacttcaacgagagtgttcctaaccaaacgattaatgcgatgagtttacttatcgtattaacactcagatcgctccaattgtaaatatcctcgatggggtgtcccataatcatctgaataattgcaatgataataccaccaagaatgtagttaatgataacgggccaccagtactcagagcgtgttgctgtacccgaaaagtttaaaagattgtcccaaaatttgcgataagcagatgccatcgtaatccccccaataaagttatgatgtggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgatttgcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtagatcattcaaggagaaaccaattctcccctgatttagccaattataaatagatttagtagctagtttaaattcgtgagcaatcattcctggtgaccagcttagacgtaaatggttgagaattttttgctttaactcatcgctcagcttagttttccgaccacatcgtgatcgcttgtattcggcatctgtttgtgctaattcagcctgataaggttgacatcgagataattcataagaaattgttgacggtgatcggttcagccgaacgcccatttggatattggacagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccatgtgaacattattattttttccctgtgttaattgggattaattaataactatgtttaactataatcaaaaagttaatagtacgcaatcaatatgttgattatattaataaaaaatacgtcgttattcgatgactgctggtacgatcaattcgaagcggtccgtcaaataggtcaattcaattggtagtttaaccgctgggtcgccgtcaatacgtgtcgtcacggcttgaccagttgcactcgtaattcgtgcactggttgccgttagctgtgtaatggccttggagttttgcaagttccccgttagtgcgaaccaaaaatatggaattacttgccgccagccaatgttgttaagtagactaatatgcatttttcctggagcagacgcgctatagacgtgtccaccgactgatttggtcgttgtaatcaaacagaaccatgtttttaaggtgtggcttccttcgtgtttgaattgatatcgaattggcagtgacttattgtgaccaatatggcgaatagcacggtaaagatagcttaatttaccgaatcgctgcttctcagattgtcgaacttcattggaaatgtcagccaaattaccgaatgtcagtgaactcacgactgcccggcgttgattacaaactagcatgccgactgcttgggtcgccggctgagtacaaattagttcgatggccgcttgggggtcagttggtaactggtagcgggtggcaaaattattaaccgttcccatgggaataacgccgatacgaatatgtgcttcagcttggattagggctgtcattgcaacgttcagtgtgccatctccaccaataacaattagtgctgacagttgaggaagcgtttgcttaattaacgcaattgcccgggggattcctggtgttgtcagtaattgagactcaatgccgtggttcgatagcgcttgcgcggtttgatgggcgacggttgccgcttgcccattacccgcttgtccgttatagaaaatgccgtaagttgttgccatgacaatcacctcttgattaaaaaattaagtttattcatcgcttatttagtaagcttttgatagtctcagtatagcttgaacactagtttgactggaaatgatatgcatcattactgaattagtcgggtcaatgagcattttgattgctcaatataaatattatagttatgataattttaatcacacaatatcgggatggagcgtgttcacaatgggatggataggtgttgcgatattaggactaacaataggtatcgttgcaaatgcggtaggcgcacatggtcggcgtcaaacgacaattaatttaatcgcaggcttattcggtgcacttggtggccagctgtcttttggatggttcgggccaacagttgctggaatgacgttgttgccagtcgtgagcggggcgatgatacttattgtgatcggaaccgttgctgcccaggcgcttcagccgcagtaattgtgattaggcataaaaggatttgttgaagtagcacttgttagcgttatcaaaagatggaggtgtccgtaatggctaaaattaaacgacagacccctggtttttggggtaaattgtcactattgattgcaattgggcaattaggattgactgtgtttcgagaagtgcggcagttcaaacaccgccgctaaaaaggggatgacagcatgcattggttatgggtaatgattgttggcgcggcggttggtgcttttgcaggtgctatcatgagccccagtcaatcgcggggttggatcggtcacattattgctggcgttcttggggcactcattggtgaaggtgtgctggggccgatggggcctgagttagccggaatgactgtgataccagccgcaatcggtgcaattgccgtcgttctgataatgatgttcgtggttcagtgggcacgggttcgacggtcaaaacacaattgaacagtgccaattgacagcctggctgttacgctcggcatcaaaaaatgttaaacatcaccctaaacagccccacaggtgacttcgaggtactagcttactcgaagttgtttttgtgtgcgccgatgggggctctcatttgaagtggcgtaatcataaaaaaacggatggtgattttgatcaccatccgtttgcgccgtgcccacgacaaattttaatcgtcagatttcttcttcattttatccttagcttcatccacgacgcccttaacagtttcttctgcgtcagctaatttgtccttagctttgcccattaaggattgtgttttgccctgggcttcacgtgcacggtccccggttactttaccttcgacttctttggccttgccgctcaactggtccttcttgctatcgaacttcttgttaacatcactcataaaaagcgcctcctaatataagaattaaccttagtttgcgataagtgatgacaaaacgcaaccaatatgcacaatgctcataaccactcggtcagaaaggcaatcagtagggcagcaaagttgatcagccaaatttgttgtcgctgggggagcatgattgtcggatgatgtgtcaaaacgatcgtgttcaacaaaaccattaaaataatcagggcgctgagcccgtaatttgtagcgatcaacagatggtcgctggcaatgccggcccaatgagtcagggcaaaaatcaagtttaaaaaacacgcaattaagatactatggcgtagatactttaacgtggtcatcaatggtaacctcccttagaaataatcatgctgatggtttctaagaaaaaatacaccattgccaggctaacggcgtgcaccgagttttatttggatagtaacggaactaagcgcattttgaccagtccgaaagccgcggcacattaataatggttaccctcaaaaacggatagggggtgtgatttataggtttaaatcagtatcgtaattcaacggtgacatatcggtgcttttagttatcaggtcagcggcgagagcttgcattgtgttcaaggcctggtcaacggctttttgattggctttggtcagtgccatagcgagttcgtcgccagtcaaagcggcaacttgctgatccgtgacaataatgtggtgaccaagttgaatcgccaattccttttgtactgtttgtaattccccgtgtagttcatggtagtgggcgtcgactaggataccgacgtgcttgaaaatccagtatgctgaggtagcatcgtatttttctgtagcaacttgataagctgctggagtggtcgtagcaccggcatagaatggaacgtagacactttcagcggctacacccatcgccagccagtgaatcccgctcagcgtgacgggaaggtccggtcgcaattgtaagacgtgtgattcttgcgtcttggcgagactgatgggccgatactgatgtttctccgtagcagtgccctggccgacgggatcaaacggtgtgccttgataatgggacgctaagtagccttggacttggtcaatatgaattaagccatccgcccgttgaatgaacggtaagtcaaacgactcaggcgtctgggtgacacttggtgtaaagcatctttgaccataccaaacgcgaggcgtgttgtaatatcgatcagaaaggtcggccgtaccgaagacttcccggaaattcagtccattgtccattgaagctaactgattgtctaatacaaaattacgaatgtctttagcataaagataattgtcatggtcactaaagtcgatttcttggattgcaagctggttagcaacgactgcataggcatcatccgggattcgttgtgcgacccagtaatgaccagcaccagtttccatgtaccaaacttcgttgacatcactaaagagaatcccgttagtttcgtaggtgccgtgttcttcaataatatgcccgagacgttcaacgccttcacgagcagaatgaatgtacggtaaggtgacagtgaccattgcttcttcaccgatgccgtccttaacatacgggtcagcagccagtacgcgtgtattacagtaagcactttcagtagcactcattgccacgccgtactcgttaatgccatcctcctcgaacaggccatattcggcagtccattcaggggtggctgtgtatttcgcacgaatctttggcagggtcatggtaaagggatgagtttgatcctgagacttgaaggtctgtggttcttcgaattcgcggtgcgcgtggataatcatttttttcgcccaagcggcgcgtgaatcttcattacggccaatcatggtcgaaccatccgcgctggcatttttacccactaggatactagtgcaggcggaataaggattaaactgatgagtcaacatatggggccttctttctccacggtacgagcagtcaatggcggtatcgtggcataatcatttttgttaaattaattttagcatgtttagtcatcaatgggggttttcggtttgtgcttctgattagttttgcaaggtagccttaattggtcagcgtgctgggcattagaaaagaaccgttaaatcaacaacgtcgtggcttgcaaaatagaaaagattaaagtaagattaaaacattcgaaaatagtgaattaagataggagcgtggcctcatgccaatcgtacacattgatctaattgctggtcgttcacaagaacaacttaaaaacttggtgaaagatgttactgacgcggtcagcaagaataccggtgcaccagcagaacacattcacgtgattttaagtgagatgcagaaaaatcgctatagtgttggtggtgtcttaaagagcgacgaagaagcagaataggttgttcattgccggaccggtcgaatatgacgtggccggctttttttaaaagtttagaaggtaggttaaactgtgaacgaacaaattaagacggatgcattaaattcggcgcaccatttaatggtcgggggcgtcgatacattgacccttgcaaaaaaatatcaaacaccgctatatgtctatgataccggtgcaattcgtgccgaaatcgcagcattcaagcaagtttttgaagaaaaccacgtggactatcaaatcagttatgctagtaaggcgtttgcaacggtcgcgatgtatcaattgatcgcccaagaacacattcattgtgatgtggtttctggtggtgaattgtataccgcccaacaagcagatttcccaatggccgccgtctcgtttcacggtaataacaagtcactggccgagctaaccatggccttagatgccggtgttggtaccatcgtggtcgataatttcggtgaactacgacaactgacgacgttgacgacgcaacggcaacagccgaccacgattatgttgcggattgccccagggatctcagcgcatacgcatgattacatttcaactggtcaggccgattctaagtttggatttgatttggacagtgggcaagcagaccgggctatcaaagccgcgcaagccgcaccatatttgaaactggtcgggattcattgtcacattgggtcacagatttttgaagtgaatggttttaagatgattgttgataagctcgttagtgagtttgctcgctggcaacgcgaacttgatttttacccacagattatgaatgtgggggggggctttggcgtgaagtacactgccgaagatcatccgctacagccaaccgattttgtcgatgcaattattaaggaaacgcgcgcgcaaactgcagccaaacaagttccaatgttagaaatctggatcgagcctggacgctcgttagtcgctaccgctggaatgaccctgtatacgattggcgatgagaaggatattccgggcattcggaagtatttgtctgttgatggaggtatgggtgataatattcggccagctttatatcaggccaagtatgaagcggtattagccaagaatccggccttaccagctgaacaggtagcctcgattgctggtaaatactgtgagtcaggtgatatgttgatctggaatcagcaattaccggccactgcaccaggcgacgtgttagcggtcctagatactggtgcatacggttattcgatggctagcaactacaatcggaatccacgacctgccgttgttttttgtgaacagggacatagtcaacttgttgtgcagcgtgaaagctatgctgacttaacacggctggacctcccactctcagtgccggagaaaaccaagtagattagtcaccaaaaagcatttcaagagttaggctcttgaaatgcttttttgggtctgctgctgtcgtcgaagggcttgtggcaacgtttgactaggatcagtgctaaaatgggcagtatgaatttattagttacggtatacttatcattgaaggatgttaatggctgctatgaagtcattacgctggtctgaagatggctagcaggggtgccagcatgtggcgtgggatttccaagtgaccggttgcatactggccctaatttttttgttaaatctatctgctttgcttgcgttaggcgtgaagtttgttaaaatttgatagttaaagtcttcgacggtgacgatggtcaataaggtcccaatagataattaacgatttaaataaccggtgggggagttgttaaaatgtttaaaaaatggctaacttggccagtattctatgagctgacagaaatttatacggcaccacttaatatcatgtggtttgttctcggaagcgccattgcgcaatatcacttaggtacggtgaattggcttaacgtgacgctgtgtttagttagcgtatttatttttgatttagccgtcaatgtttctgataattattatgattatcggcatgctcgtgatcgggaaggctatgcgcagaagacgaatccgattggtcgcttgcagttacccgtagcgggtgtcggccgcttagcattgggattgtacctgatttcattgattcccggaatctggcttgtcatgcggactgggtggttagtgctcgtccttggattagttggctatgtgattggtattttttacacagctgggccctatccaatcaacgcgaccccgctgtgtgagacggtcgtggcgttagcaattgcatttttaattgaattgacctgtgtggtcgtatcgacgtatggacagcatccgttgacttggtcgatcgttgggacgactttcttactatgtttaccactgaccctgattttcttttgcctacaactggctaataacacagcggaccgtgatgaagatattttgaatcatcgctacaccttggcctactaccttggtaagccaggttcggtacggctgattcaagcgtttttagttattggtggcatttggccgctcgtgaacgtcttactgggactagcacccattgttacgatttgggtcgtactcttactaccaattatgtggcaaggtatgcgcccgttctttgaggtgcaagataaaaagaagacgtttattacgacggtcaagagtgcctcgctgttcttcattctatacccagtgctatttgttttagggacttggttgtaacgaattagtaaagctcacttaatttttcgcacttatcgtggttatttttatgaaagtggactatattattaccagtttataaaataggggtaagcaggatggaaacagaacagcgacagcaacgaagaattgcggtgtatcacttaattgtcacacttttgacactctggtcagcagttaacgtgatcctattatcgtttcatatcggtgattggcacgttgaaacccgcatcagtaacggcttattagtcatgtttgcggtggactactttgtgcgcctaattcgttctcgagatcggaagacttttctcattcattcagcgttcgatttgatggggattattcccatgcacccggtgtttgcactctttcgacttgggcgtttggcacggatggtccaatatcaccatttgttctggaagctcggactggatggtaagtggacgcacgattttcaccgctttatctatagcaccgggtttatctacctgttttcaattagtattgcgattattgttcttagtgcgttgctcttttccgttttcgagcatcaaagcctgtcagattcactgtggtgggccatcacaacggcgactaccgtgggttatggtgacgatacgccccatactgccgttggcaaagtgatcgcggtcgggctgatgttcggtgggattggttttattggtttgttaacgagtacgattactgacttcttcacaacgcaagccagtcagaatgtcacgatcgaggaaccacagcatgatgacgagctgcgacaactactgattaaaattgacacgttgacgacgaaggtcgatcatttacaaaatcaagttaaacgtttagaaaaatcaggctacaaaaaacaacattgaattttcggaccgttggatgcccttaatggggcgcagcggtccgttttgctatgctataataacggtaacaaattcgaaacggtggtggtgagatgggacaagcaataacacggtgggtctggctaccagccccaattgtgacccgtcaatcaacgtttaaaattcatgtgggggatttacagcggcatccagtgccattacgtgccgcacagtggtatcaatttgagcagtcacgaacaaagctaatctgctcggtgccaatcacaacgactcagtatgcggccgttacgcacttagcagctcagcggcttaaagctggtcaagcgggaatgttaccagcacccgagcagcccgtgatgacccgggggacgacgattacattcacaatgtaaagcggcgtgatgacagttacttactgtaaagatactttgtgaatggtacttgacggttggggggcacgatgctcacgtgttatattcaggctaatcaaattgccgcgaggtcgcgaattcacgaggaagtgatttttcgatgaaaacacgctatcagttacaagtcaagtacgacggaatcagatcgttaacacgttgccgcgtgttggcaatcatcattgcgagttttacgggttggctgaccgggtgcgagttagcgcaggccgccacggtgccgactatgatgcaaacttaccatccttggtccgtacgggggctgaatctagaaagcttgcgtttactggtggcaacgaccgtcttagggctagtctgttggggcctagccgcttacttaaaacctaaggccaagtgagactgagtaaacaaacgattgttgtctgacccttgatagggggcggatgataatcgttttttcgtaccgcttatgtggcactgagcggtgtcgttcaatgtgggagcgcgtatccattcccaacgtgcactagcacgccacggacctcgcgcgcagcaggtgagctgaggaaaatgatggcgaccagcaaggcaagtttggtggtcgcgttcacaatttaaaatgatcccagcttgttgattcgctgttagcaattggttgaatgaaccggtgatttttttaatttacatcttattaattaaaaaattgattagcgctaaagctagggatatgctggtaaagacaggtatttgtaaacaaaaatatgggcgcaaggacttgcatggaaattaaaatatgattaaaataagtcttattaaattaatggaggcttgcgaatgattagtcaaaaccatcgtttggatcagcaacttattgaacgtgaagaccattatatggcgacggcggcacgaatcaattactatgatttagttattgaccatgctcacggggccctgcttaccgatgttgatggcaaccaatacatcgatttgttagccagtgcttcggccattaacgtgggccatacgcaccctcgcgttgttaaggccattcaggaacaggcagccaagttgattcattacacgccagcatattttcatcatcaaccggaacaacgattggctgagcgactggcaaaatcagctcccggcactgataatgaggtggtttttggtaactctggttcggatgccaatgatgccattattaaatttgcacgggcctatactaaccgacaatacatagtcgcctatacggatgcctatcatggttcaacgtatggctcaatgtcactctcaggagttagcctgaatatggtccgtaagatgggaccgttactacctgggatcgtgcacgtcccgtatcctgatggttatcgtacgttgccgcatgagacggaacatgaacttgcattacgctattttgaagcgttcaagtatgtccaattagtctatgacttttgtcaccagcacggtatcttatttgccgtcgacgaggtcaatcaagggatgggacgaaccgggaagatgtggagcattcaaaacttcccgggaatccgcccggacttaatgtccgttggcaaatcactggcttcgggattaccacttagtgcagtgatcggtcgccgtgaagtgatggagagtctagcagcgccggcgcacacctttacgacggcggccaatccggtttgttgtgcggcggcgctggcgacaatcgacgttctagcagatgaacagttggttgcccgttccgccaattatggccgctatgccaaggaacagtttttagcgcttcaacaacgccatcctaaaattgggcaggtacggatgtacgggctgaacgggggcattgaattggtgacagaccggcagagtcagcaacctgatcctgattttgccagtgacgtcatttatgccgcttttgaacggggtgtcgtcatgataacgctcaaaggaaatattttgcggttccaaccaccactagtcatcacgaagacgcaattagatactgcgttaaccgtattagatgaggcaatggctgctgctgaacagggtctggttaaacggccccgaggcaagattggttggtaaaataaggaggattttgatgcaacggttattaaaacggttaactttaaaggaagatccaagcatatatgaagacaaagattctcacctagctcgagtattgacggtcaaggatttcttggctttaggggtggggacgattgtttcaacgtcaatttttacattacccggagtggtggctgcgaaccatgcgggccctgcggtagtcttctcattcatcgtcgcagccgtcgttgccggcctggttgcatttgcttatgctgaaatggcggcggcgatgccgtttgccggttccgcttattcgtggatcaacgtaatgttcggtgaattctttggttggatcgctggttgggcgttgcttgcggagtactttattgcgttggcattcgtcggttcaggactgtccgccaatctgcgggggctcttgtcaccattaggactaactctaccgaaagctttgtcaaatacgtttgggactgatggtggcgtggtcgacctgattgccgtcttggtgattgcgctggtctcgttactgctctcacgtggaatcagtaaggcctcccgggtcgaaaacgtgttagtggtgttgaaagtgttagccgtactcacgtttatcgtcgtgggtgcgacggcgatccacgtgcaaaactacgtcccgtttatccccaagtaccatttaaacgctgatggtagtgcttttgggggctggcaaggaatttatgccggggtatcgatgattttcttagcttatattgggtttgattcgattgccgctaattcagcagaagctaagaatcctggcaaaacaatgccacgaggaattcttggttcactcgtcattgcggtggtgctctttgtggctgttgctttggtcttagtcggtatgttcaaatattcatcatatgctaataacgccgaaccagtcggctgggcattacgacaagctggccatccgattgttgccagtgttattcaggccattgctgtgctgggaatgtttactgcgctgattgggatgactttagcagggtcacggctaatttattcctttgggcgtgatggtatgttacctaagtggcttggcaagttacatcataatcaacctaacaacgcgctacttgtgttaacaatcgttgctattatcattggggcgttttgcccgtttgcttttctggcccaattgatttcagcgggaaccctgattgccttcatgtttgtctcgctgggaatctatgctttgcggcgtcgtgaaggtgttgatattgcggtaccagcctttaagatgccgttctatccagttttaccagctattgcctttctaggcgcactgttcgtttttatgggcttagatatccaggcaaaattatacgcgggcgtgtggttcatcgtcggcttagtgatctactttagctatggtatgcgtcactcatatttggctgaaaaacgtctgtctgagactgatactacggctaaatcagcttcgaaggtggctgattcgactgttgaagagcgtgactgagcttagctaacgcaatcccttgatagttgaacaacaactaaaatggcacttccagaattgaattttatctggaagtgccatttttgagtggtgattacgagctagtgtaaagtccgaaaattaatagtgatgcgcagtcagcaacttaagataccactgacgactacttgcatccgaacttattccgcaattgcaaaataatcgttcaagtaacgagcaacaccgttttgatcattattataggccgttacatcgtcagccgttgctttgatcttgtcggtaccattggccattgccacaccgagacccgcgtatgctaacatctcgaggtcgttatgttcgtcaccaaaggcgatgttattgcgccgtgaaatttgaaagtaatccgctaagtaggcgacacccttggctttgtgtacgcctttggaggtaatctcgaggatggcattcgggccgccccaaacaccaacgtcaacttgatcgccaaagcgttcagtgatccagtcaatgatggcagcccgccgatcaagctggactagcaagacgagggaattcggattacgagtcaacgtatctggtgtaagtcgggggctgtcagcaatctctgggaagaattgaccagcaatcaaatcttgacccgctgtcatggtactgtttttattttctgcaataatttcattgatccccaattgttcgcgatatttaacgagtgctaagacaatcgctttgttgatcgtgaactgatattctgaggcccatgtttggtgaggtaaatggcccagagaaccgttaaagttgatcattgggcttttgagacgcagctggtcatagattgcttgtgaaccctgatatgagcgaccagtaataatgctaacaatgtgacccgctgcttgtagtcgttgcatcgtttggatcgtcgctgaattgagtttggattcagcattcaaagtggttccgtctaagtctaacgcaattagttttctttccatattcaacaaacatctcccatatttccggcagttaattaatttaatttagcataaatcccacctaattgcgaatctttgctaccttacagtcggggcaaaatgtggtaatctaattgaggatgctttttaattgaggaggaaatttgggtgcaattaccagcagaatttgttcaaaaatatcaacgactactaggcgatcaagcgcccgcttttttggcagctttcgatggccctgttgaaaaagggtttcgggttaatccgaacaagactgtgacggccacgatgcgcgccaagatgacagcacccgttccgtatagcccaattgggtattatggcaaggtgaacggcaatgcgctggaacacttggctggtgccgtctacagtcaggaaccaagtgccatgaccgttggcgagtttgcaaaaccagcacctggtgaacgagtgttagacttatgtgcggcaccgggtggcaaaacgacgcatctgttaagctacttgcatcagaccggtctactcgtgacaaatgagatcaatcggcaacgggtgaccgcccttggcgataatgtggaacgctacggcgcccgcaatacagtgattaccaacgatacacccgccgcccttgccaaggaattgccaggcttttttgaccggatcttggtggatgcgccgtgttcgggtgaagggatgtttcgtaaggatcatgacgcagttcagtattggacgcccgactatccagcggcgtgtgctgaacgccaacgggagattttgacggaagcggtcaagatgttgcgtccgggtggacatttgatttattcgacctgtacctttgcaccggaagaggacgaacagatgatggcctggctgttaaaaacttatcctgagtttgagctggagccactggccaagacggctgggatggtcgatgcaaagccggaatgggcggatggcaatcctgaactggctaaagcggcccggttatttccgcacttgatgcgcggtgagggtcactttattgccaaattggtctatcatggcacgacggtgggcaaggacaaaaaagtggttcgcgaacagttaaacgccacgcaacggcagctatggacggactttttaaaaaaacaagcaatggccggtttaccacagctcgtgttacaggcacatggtgatcagttatacggcgtgccagcgatgatgcccgttacgcgaaagctcaaggtctttcgccccgggattttattgggaacgtttaagaagaaacggtttgaaccaagttacgcgttagccttagcgagtgatgatttgtccttacccaaaactgaaataacgcgtgaacagtgggcattgtatgtccatggtgagacatttgaattgacaagtgcgcctgtagctggttttagggtcttaacttgtgatgggttgccagttgggtttggaaaaatcgtcgccaagacggttaaaaatttctttcctaagggcttacggttcttggcgacctctgaaaacgcgacgctctaatctgatatgatattgactaagtcataacgtccgcgtgcgattgacgctgaacaggtgatgagcagcggccgttatgaatcattcgatccgtggtaaaatcgggggaacgatctactcaagttgctggtcaaatggacccaatcaatcgtgatattggaggaagagtttatgtattgcccaaattgtgggaaaaagaatgatattgacgcgttattttgtgaaaattgtggtgcgcggctgattatcccagccagttcagcgcaaccaacaccggcgtcagctgtaagttctgctgctcaatccacgtcgtcaacggctgcttcagaagcaccgagcgccagtacatcgatttcggctgcaccgactgcacctgaacttagcacccgttcagcgcaacatgcgcgtcaaaatgcgcaaccacgttcaacgtcaaaactgtcttgggttattttgatcgtggtattagccgtggcacttggtggtggctattactggctgggataccagcgtcagagtaattcgacggcaacaacaacggccaagtcttcgttgcgcactgctacatcggaaaaagccgagtcgtcatcatcgtccaaggtatctgctagtacggcaactcagacggcattgtggtcgacaaccaagtcgagcgagttagcctcgtttatgtcgtcatggcaagataccatgaaccaatcgtacgaggggacttatgatggtcagtcggtaactattggtgagttgaatttaccttcagacatcaaaaacaatcagtaccaagataagattacggtcaatggtgacacagtcaagctcaagtggacgacggctgctgataccgatgcgaagtaccaggtcgttgccgcggccactgatccgaacgcgtctagtggcgtgattacgtatctgtatgttttccataatggttcgccagacgttctggtctcgcaagacagtgccactgccacaacgtttaacttcactagttcacaaaatacggatttacaagatggctttgcaaagattgccaatgcggattaataactgaattattcggaatcgtgtgtttatgctaagtcggcctgaacacacgatttttttgcgccaatattcgacagaaaatggcgtattggcgctttaaaactgaataattagtgtcgggtaatggaaagcgatgctgatttacaatcgattattgaaaattattatttatttacaaaatgatatccgtcggctggagcagtttattagtgcaacggcacgcaacgtttcagcgcctgcatctatttgttcatgcaacagtatgcaatataatgacttttttatgaattatatgtgaattttatatgaatcgatgtatcagctaatactatttgaacccttgatattagccgatttcatgccaaataggcacggatgccaataagtaaaacgccttcatgcaatttcacgcaaacgcttgcataattttggaagcggttttataatctaacttgtactcaagcgattgatattatttttgggaggctttattgtgaaagaaacatctaaaacaacggccggattaccgaaactgtcatccaataagatttggatgatgagtctaggttttctcggtgttcaaatggcatttacacttcagagctcacagatgagccggatcttccaaactttaggcgcggatccaaataaccttggctggtttttcatcttgccaccccttgctggtttgatcgttcaaccgatcattgggagtttatccgaccgaacatgggccccacgtttaggcgggcgacggttaccttacttgattctgggaacagtcgttgcggcaatcgtgatgttactactacccaattctggctcgtttggatttggttacgcttccatggcggccttagtttttggtgcgattaccgtggcatttcttgatttatcgtctaacgtcgcaatgcaaccattcaagatgatggtcggggatatggtcaacgatgaccaaaagagttacgcctatgggattcaaagcttcttgttgaatactggtgccgtcattgcggcaatcttcccattcctgttgaccttgttcggggtcgccaatacggctagtaaaggtgttattcccaattcagtgatctggtcattttatattggagcagcaatcttagtggtttcaacgattatcacgattgcccgggtgcgggaatatgatcccgtaacttacgcgaagtatcacggcattgatgaaagcgctaataaatctggtggtaactggttggcactcttgaagaaagcaccaaaggttttctggttagtagccttagttcaattcttctgctggatggcatttcaatacttatggacatactcaaccggtgcaatggctgccaacgtttggcacaccactaatgccagttctgcaggctaccaagccgctggtaactggtacgggatcttatctgctgttcagtccgttgccgcggttgtttggtcatacgttttagccaaggttccgaataatcggcataaacttggttatgctttgagtttattacttggtgcaattggcttcttctcaattttcttcattcacagtcaatcagcacttgtcgtctcatttattctggttgggatggcctgggccgcaatgaatacgtatccattgacgatggtaaccaacgccttatctggcgaacacatggggacttacttgggtctctttaacggctcaatctgtctgccacaaattgttgcgtccttattgagctttgcattatatccattatttggcaattcacaagccaacatgttcatctttgctgggatcgtccttgcagtaggtgcgggcacagttggtttgatcaaagaaacgtacaaaaactaggaggaattaacttatgaaacgaatttttgatgttaatccatggcatgtcttgacgactgatttcaaaccagaaaacaaacggttgcaagaatcaatgactagtctaggaaatggttacatgggcatgcgcggtttctttgaagaagattatactggggatacgcttcccggtatttatcttggcggtgtctggtatccagacaagacccgggttggctggtggaagaatggctatccagaatactttggcaaggttatcaacgccgtcaatttcatcaaaatcaatttcaaactcaatgggactaagatcgacttggcaactgccaacttcagtgattttaaacttgacttggatatgcaacacgggactttgacacgatcatttatcgttgatcaagatggtcaacgggttcgcgtgacctttgagcgtttcttgagtgttgcgcaaaaagaactttcggttcagaaggtgacgtttgaaaacttgagcgatcaagcggtggaattaaaagttgcttccgcactggatgctgacgttaagaacgaagatgcgaactacgatgaacatttctggaacgtccacgaagttacggatgatcggttaattgctcagacggtaccaaatgattttgggaccccacagtttacctctgggatgcaagttagttatgtaacgagtttaacccataaagcggccgaagtgactgatacagccacggttgatcgctacttcggtacgttagaagctggggccagcgttagttttgaaaagcgggtcgtcgtggttacgtcgcgggattatccgactgatgatgccattatgactgcacttcaacgtctgacagatacggtcagcgcccaatctttcgatgatttattggcggcccatgaagcgggctgggccgatcggtggcaacaatcagatattcaaattgaaggcgataccgaggcccaacaaggcatgcgtttcaatttgtttgaactctttagtacttattatggtgatgatccacggttgaatattggaccaaagggctttactggtgaaaagtatggtggtgcgacttattgggatacggaagcatttgccgttccagtttacctggggattaccaaaccagaagttacccgcaacttactgatgtatcgttataagcagttggatggtgcctatcataatgctcgtcaacaagggcttgatggggcattgttcccaatggtgaccttcaatgggattgaatgccacaacgagtgggaaatcactttcgaggaaatccatcgtaacggcgacattgcctttgctatttataactacacgcgttataccggtgatacatcatacgtcttacatgaaggcagtaaagtgttgacggagatttctcgtttctgggcagaccgggtgcacttcagcaaacgtaatcagcagtacatgattcatggggtcactggcccagatgaatatgaaaacaacgttgataataactttaataccaattatttggcgcaatggacgttgaagtacacgcttgaaattttagatcaggttagtgacgaccaagcagcggccttaaacgtgactgctgaagaacgtgcccactggcaagatatcgttgatcggatgtatttaccatatgacaaggatctggatatctttgttcaacatgatggttatctggataaggatttagcgcccgtttccgcaattccagctgaccagttaccaattaatcagcattggtcatgggaccacatcttacggtcaccttatatcaagcaaggtgatgtgttacaagtgatgtatgactttattgatgatttctcaaagacacaattgaaacacaattttgatttctacgaaccgatgacggttcacgaatcaagcttgtcaccagccatccatgccgtgttagctgctgacttacactatgaagacaaggctgtggctttctataaccggacggcacggcttgatcttgacaattacaataatgatacggtcgacggtcttcacatcacctcaatgactggtggttggattgcgatggtccaaggatttgctggcatgcgtgttcatgatggacaactgagttaccggccgttcttaccaaaacaatggacgaagtattctttccgtcaggtcttccgtgatcggattattgaagtcacggttgatcacaatgggacgactttgaagttgattaccggggaaccgattgatgttcaagtggatggcaccacgcaaacattgacacagaactagttcaatccgcactgatcgaagggaatgaggcgtacgatttctgcagtaccatttggtgtgtatcaaggcgagtcagtctatttatacacgattgaaaatatccatcatagcaaactaaaagtgttgagttatgcggcaacgtggtatgacttcgaagtgcaggtcgaccgccagccacactcattggtgcttcactttgataacttggcggattatatcgagacgccttatcaagtcggcaaaacagtgggtcgagttgctggccgaatcggtaacgcgacgttttccttgaatgggcagacgtatcacttacaaccaaataacggccggcatttgctacacggtggcaatcatggcttacaaacgcataattttcgagctcgttttgatcctgatggcgacactgtcacattgacgacaacgctagcgagcgctgacgatggttttccaggcgacttgacggtaactgtaagctatacgttaacggccgatgatgaggttcaaatcagctatcacggggtgaccactgctgatacgttattcaatccgacctgtcacgtttactttaatcttgatggtcaggccgcactgattaatccccagcaattacgtatcaactcgaccaagctagttcatacgaatcacgagaaggttccgaccggcgtcttctacgtcccgtcaccagcgtatgactttcgtgagcagccaacgattcaatcgcagctcgatcgattgatccaagaaactggcaggacggaatacgatgattgctatgtgcttgaccaccaggatgaacccgctggcgtgttggcaacgactcacgggcgactgctcatcaacacggatcgcaatggtttagttatctttaccgctaatcccgaacgaacgcagtcgtatcgtttaggggactaccatgcgctggccgtggaattgcaaaccttgccggatgctattaatcatcatggctttggcgatgttgttctacgggctggtcagccacggacgtacgtgaaccgctaccaatacgtgtcaaaatagcaatcaatagatgatggaaattattttctttaccacgatcaaaaagcagtgcttgccataggggcacactgcttttttggtgtacttggttataacaaaaacgcgtcatcacaagtatagaatgacattccgtagtttgtgatgacacgctttgttttaatctttaatcgattgcttgtagttaacaagttcacgtgataacagaatcttgtcctgaatacggctacttttgaattgatcaacacgcgttacgccgacgagtgcaaataggcgttttaattgcgactgccaatccgtcagcatcgcaatgacttcgtcgtccgtatgatggagtaaagcgtgtagcacggtgccagccatgccgaccgcgtcagcgcctaacatcaacgcttttaagatgtcgagtggctgtcgaacgccaccagcagctaagaccgtgagatcatccggtcggttctgaacgcctagcaaggactcaaccgtggtgaggccaaagtcgtgaaggtaggccatatcgcggttagcacgtcggcgattctcaatgtcgacaaagttagtcccaccgtgaccgcctaaatctaggtagcgtacgccggcagcgtagagctgttgcatcgtggggcgggaaataccaaagcccacttctttgacgatcactggtaccgttaaggcttggactaagtccgaaatgttagttagccaatgaaagtcacgatcgccttctggcatgacgatttcttgaacgacattgagatggagctcgagcgcatcggcctggagcattgcaatcgctgtttgggccgcagataacgggtggccggcaccaagattgccaaagatcagcccgttcggattgtggtcacgcatcgtggcaaaagtgggggctacttggggatctttgatggcgacactttgagagccggtcgcaatcggtaagccacaagctgcagcgatgcggcctaaacgagcgttgatttcgcccgttcgctgtgagcccccagtcatcgcttcaatgtagagggggctgtcccaatgccactggccaacggtggtggctaaatcgacgtcggccacggcagtttccggcaacgcgtcgtggcgaatccggacctggtcaaaggcattggcttgttcgccatgaaaatacttttcagctaacgaaacatgttcatctttccgatgagattgttgactttgtggcacggtgccacctccaattaatttagaatctgaaaacgagtccggcaaggctgccaggctcgtcaataaactgcttaagaatttggtaaaacggtatcctgaaccgtatgcacgtttaagttaagttgttcgataccatcgtgagcccacgcagttaataatggtcgtgggtcgatggtttgatcaatcaaaacgatcccacagtcaccaccaccagcgcccgaagtctttgcggccgcgccagcactttcggcgagttgaatcatacgctgcagcaggggtgtttcaatcgtcacgtgactgaaatcgcccaatttctgaagtagttgacgattcgttcgcaactcggtttgaatcacgtgcaagtcactgtgatgaaaaccagtgatcatacgttttagacaagctttgctggcttttagaaaggtctggtattcgctgcgttgcttcgccttgactaaggccactttatcgactaagtgtgatgtggaggccggtgaacccgtccaaccaatcatcaaacgtaaggctgctggaggggtcagtaactcgatttttaggtcgggccacggcattgtcaacaaatcacttaagcttgactgagcttgttgtaggtgtaaccattgccgatcgaatgaatggtaggcgatccagccaccatagacgctggcagcaatgtcaccaagcgaaccattgccttgcacggatagatgggcaatcgcggctaatttgaacagtttatttttatccatcggtaaatggtaaaactgacatagtgctttgacggttgccacggtcaccgctgctgaagagccgagaccgtattttttaccatcagcactatcgagctcgctattgataccgagatgataaacaccaagttcacgccctaattcatgggcataactttcagtgagattgatcgctgctaaaatataatggaagggattgtcacgattatcaaaaaccatcgcgtctccctgacgtcgccagacgattgagttttcttgatactgctcagaaacgatgctcccaatcgtttcgctaggtgaaatcgttgccgtcacaaattgatctagtgcaacaataattgctggataaccactttccactacggcgtattcaccggcaatgtagagttttccaggggctttcaccgttatcatgccatcatatcctttcatgaccatcgctgatcattttaaattaaactgaattatttttccgttatcgtgatacctggacctggtttagcgacgattaattgatcagcgtcaaaatgttgttgtaacccggtcataatggtgtcggtatcttgacccgcacaaatgattttgacgtttgggccagcgtccaaagtataataacagtttatcccgtgtgaacgcaagtcgttgactgcttgaatagccgtcagtgtatccgcggtgaagtagttaaaggcgggttcagcgctcaaattaagcgcgtgcattcgcattgcgttcgtttcagcaatttggccaacagtagtgagatcacgatcggcaatggcttggcgcattcgcttcaagtccgtctcagccgtggtgatccaagctggatagtagggggatgtcgcgacgacccgtgccatgccgtccgttgagctgattggctttttggtggccttcaaaacaacggcgatcatttgaatgtcccaatcgaccgggtcttgtaagacttccgcgtaagaactctgatcatcatggccggcatgccattcgacaaaaccgccaaaaattgagcgggtcgcagaacctgagccacggcgtgctagtcgtgatagatcagccgcatctagttgtaagccagccgcacgactagcagcccctgctaaggccgcgaatccggaggcggaagaggctaagccagctgaggtcggcacatgattttcagttttgaccgttgcatagttggtttgaccactgcgctggcgaataaggtcgaggaactggctgattcgtgctgatttgcccgtgggtaagtgttgatggttaaagtaaatttggtcagtatcgagatgctcatcgaaggtcacactggtctgggtatagaagtgatcaagggtcagcgaaatactcccattttgtggtagcatcagcgccgcatcttttttcccccaatatttaactaacgcaatgttagtatgggcctttgccgtaacggttttcactatgtcttttcctccaaaattaaaattagtcatcgcacaaaagtggttcgacccaagtcgcagtcgcaccggctgcggccaatttttgtgataattggttggcgatgctggcttccggagcgagcgcaatcaagcaaccgccctgaccactaccggttaatttggcagcgagcgcaccattttggcgagccactgcgagtagttgttcaagggcaggatgactgacacccatggaacgtaagtcatcttgcgcaccattcagggctgttgccagggcccccatgtcaccatcttcaagcgcggttcgggtctgacgagtcaatcggcccaagtcatcaatgcgtgcttgaatcgtcgcgccctcaaccattagtaagttgcgaacggttgccactgcaactttggtctgacttttaatacccgtgtccgcgatgactaaatagccgggaagctttaccgggatcggaaagttctcacgacccttgacaaaccagacgggacttttggcactggccgtcgcaacgtctaggccgctgggttgaccatgcgtgtaactttccgccacattggcagtggccaataattcttggtgggagagtggtcggtcgaagaaatcataaaaagcccgcgttacggccacggccgctgcggctgaggaccccattccgcgttcagagggaatatcgctcgtgatgtgaatatcgaagccctgctcgggggcatcaaaacgtgcaagcaaggttctaatgagcgtctgaataccgcctaagttggcagacatcatcttaaagtcgccgttgaagtaacggcttttgaccgtctgcgctgcatcacggcggtgaataatggcctgcatttggatggtcgaaatcggtaaggcaatggcgggttgtccgtaaaccacaccatgctcgccaattaaaataattttggcatgactagtaccggtagctagatctttcaatcgtgtcgctgcctttctgtaagtagattaataatagcttcataataccttattagcgcttcttttgccatgctaaccccggcgaacgcgctgaattcagttgaaatgtaagttaaactggtttggaaagtaacaatttaattaaattaaatcattcacgtgaggggcgtatggacagactggttatcaacggcagacgaagatcgattactatgttaaaattagtaaatgattagaaatcagtccgataatgatgaaaaagaagttgagctgcttgtgacggactacgtggcccagaattcactaattaggaaagtaaattttgggtagcagtgccggctattcaagcgcgcgtactcagctgactgtgttatggcagatgtacgccgagacactttcatgaactttatcgttgctcaatcatactcttgaccagtctctgcccgttgtcctcagactgacgaatttggcttaagagttggtcgagctgagttccctgcgccgaatatgctataatttacaatgatcgacgtgacgtatgtgtgacgatcggtgtgaaggatgagccaagcggcttgtgtcatcaggacaacttgtgtcactggcacagtttagtaggttgaactcagctaagttgggcttgaccgacgaaccgttcaaagttagtggtcgagaccaagtgtagtgctacttggaccagccttcagtctgattacaaacacatcgcacgtgatatgccataaagatcgattagttggtcgaacatcagcgttagtgttgatgacggattcacgcgataaccaatctaatgaacatctttacaattcataacttggggaaatgaccatgaaaccaaacacaacttatgcggtagttgatattgaaactactggaactagtgtgaaggacggcgaccggattattcaaatcggttgcgcgtttgttaagaataataaaataattaatacatttgccacggacgttaatccgttaaccacggttccggccgttatcgagaatttaacggggatcagcaatgcacgggtgcgcaaagcaccaccctttgatgatctggctggtacggtatacagcttattacaagggactgtttttgtcgcccacaacgtgaactttgacctgccatttatcaattcagaattgcagcgtgtcggttatccagaactaccaattcaggccgttgacactgtgtctcttagccaaattctgttaccgactgcttcgagttttcggttgcgggacttgagtcacttgcttgcgattgaccataatcatccacattctgcggatagtgatgcaattgctacggcccacttgtttatcacgttacaacagcggctcgcacacttaccattgatcacgttacaacaaatggtgcaattagcaccggagttaccacgtgaaacggccgacttgtttgcatacgcctttcaacagggcaaacaacatccacagcagttaccaactgacttagtgatcaaaaacgggctcgctctgcgtaaacagcgattgccacagcaagccgcgggtcgtaaagcggcacgctatccgttgacgaaagcacaaaagcagcatatttttggtgatcgcttgacttatcggccacaacaggcccggatgatgaaccagatttatcggcactactcaaaacagtctgctgaacaagtgccattgttgattgaagcaccgaccggaacgggtaaaacactcgggtatttgctgccacttgcctacttggcacaggatggtcaacaggtggtcgttagcacggcgacgacggtcttacaaacgcagttacgtgatcagggtgtggcgttgttgaatcagttgttgcctaatcctgtgacggcggttgtgattaagggtaatcagcattacgttgatttaaaccggtttgcccgtggcttggcgttgcatgaacattcgaagcaaacgcaattattgaagttgcgcgtgctagtgtggttaacgatgacaacgactggtgatctggatgaattgcacttgagcacgtatcaagcgccatactttagcgaaatcgcccatcatggcgtggcctcgttgaaagctgatgacccgttttttaaggaagatttcttacgctttcgggatcaattgaccgcgcaagcgacttttatcattaccaatcatgcctacctgatgcgccacgtggcccaattgggtagccgtcaagagcggccactgctggttcttgatgaggcccagcatctggcagatggtgtcgttcgtgactcacggcagacctttgatttcaatggctacatggcgacctgccacagcttgatcagtcgcattgacacggaacatagtctaaatttacgggcactgttcgcggaacaaccacaggccgattatcgtctgaaattattagataattcattgaatgatactgacctacacctgcaacaactgcaggcggcgctagctagaacgtttgtaccagcacaaaagggcggcaatcagcctgctgaattaggaatcaccacggatcagttgactgatttctttgcggcccacaatccgctgatcaaacaattacaaacggccatcgaaaactgttttttacagtttcaacaattaaatgagcagtatcaacatgatcaatcgcaaatcttgcctagtgaacaacacgtcctcgacgactttgacaatcgtcttcaacatctccgtcagggctatgagttattacaaacgtggttagtgccagcttcgcgggaacaacgggtcttctgggtgagccttaatcaatggcatgatcgcggcagtctcacgctcgcgggtagcttgatcgatacgcaagggtattttaagacgcaactatatccttacttcagtgcgccactattaactggtgccacgctatttgccactgggaaatctcagtacgtttattcgcaattggatattgaccaagcaacggctaagcgtcaccgattatcaacaccgtttgatttagaacaccaggcacggctattcgtcgctacggatgctactgcggcggaagcacccagtggcaagcagcgcgtggcatacttgacgcatgcgattcacgacatcgtgatggcagcgcctaagcaaacgttggtcttgttcaattcactgaatatgattgaagcagtcttttacagtttgcatcaaacggatctacctggtgatcgcgaaattttggctcaaggcgtcaatggtagtcgtgaaaagctgcttcgtcgctttatgcagggggacgatgccattctcctgggtgccggtagtttctgggaggggatcgacttgccacaagaacagttggaattgttgatcgtcacgcaattaccgtttgaatcgcccgaccagacgacaaccaaggcccgttatcaacaactaaggcaagcacaactcaatccgttctataacgaagcgttaccgaaagcggcattgaagttacgtcagggaatcggccggttgattcggacggatgaagaccgaggggcagcggtgattctcgatgaccgtttgatgacgaaacgatacgggcagacgattcttaaagctttaccgaaaacgttgccgcccgcaaccggttcattgacgatgattacgcaggaacttcaaagttttttcaaaactaagtaagaaaccattccgcaatcagttaaatttgctataattaatttatctgtttttgaaaggaagagcatatgcgagttcaacgtagaaggcgccctgagcgactcattatgattattctggtcgtcattttagctattatcgtggcggtctatggcacgttatgggccgcacaacggccaatgcaccaagcccagaagacggcgtatagtctggccgtcagcaagggcaagctaaagaccacgacggccttttcacagtacaatggcaccagtagttattacgtcgttacgggaacgtcgagtaaaaatgttccggtatacgcgttaattaacgcgaataaacatcataaaacgaccgttatcaaacagtccgctgggatttcacgtacgaaagccttgaaaaaggtctggtctaaacgcaatcctagcaaggttatcaaagcgacgcttgggaagtatgatgggacggtcgtgtgggaaattacgtacttgaaccagaaaaagaatttatgttatgaaattttgcagtattctaatggaaaccagctgaaatcaattattaacatttaaggttaaaggagtgcggatgtacatggaattatcgcgtaaagtaatgcaggttcaaccgtcagcgacattgaagatcagtgcgactgccaagcaaatgatggcggacggcgttgacgttatcaatttaggaatcggtgaaccggattttcagaccccggataacattaagcaagcagccattgatagtattcaaaatggtcaagcgagtttctacacaccggcaactggattaccagctttaaaacaagccatcagtcagcgaattgaagctgaccatcactaccattttgatcctaatcagatcgtcgtaacggatggcgcaaaaatggcgttgtttacgttattccaagttattctgaatcccgacgatgaagtgttattaccagtcccatactgggtcagctattcggagcaagttaaattagctggtggtgtgccagtcgaagttagcaccgatgaacagttgcggtttaccgctgctgatttggaagcgcagcggacgcctaagacgaaggccttagtcttgaattcgccacagaatccatccggtctggtattcagccgtgcagaattgacggcgatcgtgaactgggccgttgaacacgacgttttggtaattgcggatgaaatttatgaaaagttattatataacggtaatgaatttacatccgtgttagaattagatgatgctaatatggatcacgtggttttgatcaatggggtttcaaaagcctattccatgactggttggcgtatcggatatgctgccgggccacaaaccatcatggctaagatgggggtcgtgttaggtcacgctgctagcaacccagccgccgtatcacaatatgctgcgattgaagcttttagtggtgaccaatcatcggttgaaacgatgcgtcagggctttgaagcgcggttaaacgaactatacccactgatcgagcgtttacctgggtttaagatgcctgctggcaaaccagcgggagccttttacttgttcccagatattacggaagcattgcgtttaacaggctatgcagatgcaccggcctttgtgacggcagtgttattagaagcccatgtcggtttagtgcctggagaggcgttcggcatgcccggttgtttacggttaagctatgcaactgatatcgattccttgcgagaggcccatcgacggttacaaaaatttatgacagaaaaaattgctgaacaagcaaagtaattggaggatgtaagtaaatggtgcaacagatcaacattatcgatgctaaggaccatgtcgacgaaaaagtaaagattggggcttggctcactaataaacgttcaagtggtaagattgccttcctacaattacgtgatggctccgcctttttccaaggtgtcgttgttaagagccaagttagcgaagaagtttttgaactcgctaaggaagttaagcaagaagccagcatgtggattacgggtgtgattcatgaagacagtcgttcaaagttcggttatgaaatcgaagttgaagacattgtagtcgttggtgaaagtgaagaatacccaattacgcctaaggaacatggggtggacttcttactagatcaccggcatctatggttacgttctaagcggccatgggcaatcatgaacattcgtaatgaagtcattcgcggaacgtatgaattttttaatcaagaaggtttcattaagatggactcaccaattttgactgggagtgcacctgaagggacaactgaattgttccatactgaatattttgatcgggatgcctacttatcacagagtggtcagttatacgccgaagccggagctttggcctacggaaaggtctttacttttggcccaacattccgggctgaaaagtccaagactcggcggcatttaattgagttctggatgattgaaccagaaatggccttcatgcatcaagaacaaagtttggaagttcaagaacgttatattgcctttcttgttcaaggtgtgattgatcattgtcaatacgcactcgacattttaggtcgtgatgttgaaacgttgaagaagtacaccaagttaccttatccacgaatcagttacgatgaagccattgaattgttgaaagaaaatgactttgacgtggattggggtgttgattttggttcaccagaagaaaccttcttggctgatcacttcgatcaacccgtcttcgttttgaattacccgaaagccatcaagccattttatatgaagccgcatccaacccgggacgacgtggtgatttgtgcggacttattagccccagaaggctatggtgagattattggcgggtcagaacgagcaactgattacaattacttacttgaccagatcaagcaagccggcttaaatccagacgactatgcttggtacttagatttacgtaagtatggtagtgttccccatgctggttttggtctgggactcgagcgattcttgacttggattacggccgaagatcacgtgcgggagacaattccgttcccacggttgttgaaccggatttacccgtaaactttaattgaaggttagttttattaagagcgtgggacctagtctcacgctcttaatagtgaaaggatgataacgagatggagtccttagctgccgcgttagtgaatgatggtcaaacgaccattgcgaacgcattattggcccactatcgtgaaattggggtcacaaacgatgaattattggtttacttgcagttcaaacggttaattgatcagggtaatcaatttccagatgctgcggtaattgccaagagtttaggtgaatcgacaaatgccgtttttcagcggctacatgaaatgttagccaaaaaattgctgacgattgaatcgatcacggctgatgatcaaaaaattcatgaccgttataattttgacggcctgtatgataagttagcagttgcgctcaaaaaacagccagttagcactcaagcttcggaacaagccacgagtgaaaacagtcggcaaagggtttttcgggcaattcagacggaatttggccgtgacttatcaccgatcgaaatggaaagtattagtaagtggttcgacgaagaccattatgaaccggaagttatcgaattggcattgcgggaagcagttctgcgtcaagtctataacttgacgtatatggaccgaattctgttgaactggcagaaacgtaacttaaaaacggctgcccaggtggaagcagagcgccaacgcagtattgagcaacgcttgaattccgctccgcaaccacaacgccagacgggcgcaaatgctggtccgaagattccattattcaaattaggtgaagaccagtcttaaacactgtgctgaaaagcttatcggggaaaactgatcttaaataaagtggtggcgattgcctgtgcgaggcgtcgctaccactttttttcgggatgggttagtcgttgtttcatatcaatggcgtttgcccacgtcattggcgcagcgtactgaggttaaaacaggaccaccaggatttcctgtcctggtaagccggtgggatgcacatcattggaccaaaatcagtgggcaccactataaattagaaaatggttataattaaatgttgacttctcattaaaatagcgcaatactgtaaacaaccaagtaaatatattaataaatacgtctaagatgagtagccgttgttggaatgccttagagaactgccggttggtgcgaggtagccatttcgcaacgttgaagatggtcttataatgcaagtttcaacgctgagctgacggggttaagcgttgacggctacgcccgttatgcggttagagtctcgccaagaattttcagtggcggtacttgaagtgcggtggcctgtgagggtcatttgaagtaaggtggtaacacggaaaaacgtccattcgtccttaatctgataatcagattagagacgatggacgttttttaatgggaggaagcagactatgacagaggcaatcattgatttaaaagacatcgcagtgacgtttgacgacgggcaccaagtcgttcacgcggttcaagatgtcaatctacagatccagacgggtgatatttatggcattattggatattccggcgctggcaaaagtaccttggtacgggtgatcaatttattgcagtcaccgacaacgggccaggtagtcgtcaatggccaggccttacaaacgctatcgccagctgcattacgtcaagcccggaaacacgttgggatgatttttcaacacttcaacttgatgcaatcacgaaccgtgctgggcaacgttatttatccattattgggtcaaaaaattagtaaacaggaccgacgcgccaaagcattacggctactgaagctcgttgggttaacggactatgcgcagacctacccagataaattatctggtgggcagaaacaacgggtggcaatcgcacgggcactggtcactgacccgcaaatcttgatttctgatgaagcaactagtgcgcttgatccaaagaccacggcggcaattcttgagttgctacaacgggtcaatcgcgagctagggattaccattgtcctcattacgcatgaaatgcaagtcatcaagagtatttgtcatcatgtcgccgttatggctgatgggcggattattgagcggggccccgttgctgaggtttttacagcccccaaagcacctctgaccgttgattttgtggaaacatctaccaatgttcgggccgccattcagcgaatcacgaaaacgattaaattgagtgaattagcagcggaccaagagctgattgcgttcaaattcgttggtcaatcaacaaagcagggaattgtctcgcagttatcgcagacgctgggggtcgacgttaacattttgtttgccaatatcgaccagatcgatggtcaaaatgttggtgacatgattgcgattattacgggggatttaacggccttcaatgcggcggtcactaatatgtcggctcaaggtgtccacactcgcattatcaatgaagaagttgtgaagggaatggtggactaatgacagcattaattccgaatgtcttacaaatgaaagctgaatttattcaagcaacgttagagaccctctatatgaccgcagtttccgcgctggttgcaggaatactggggttgggtttaggggtactgttagtggtgacacagccccatggcattttagctgatggcccctcgtatcaagtgttagacaagctaaccaacttactccgttcggtgccatttattattctgttggccgtaatttcgccgttgaccagctatttaatcggaacaacggtggggaccacggcctcgttagtcccactagtttttggtatttttcctttttatgcccggcaagtgcaaaatgcgttactcgatgttgaccaaggaatcgttgaggctgctcagtccatgggatctagtcccattgcaattatttttcgggtttatttgaaagagggactacctgatttgattcgcgtctcaattgtgacggtgattagcctgattggtctgacgacgatggctggtgcgatcggcgcgggcggcttgggtgatattgcaatcagtattggttacgcccgctttgaaaacgacgtgacgtttttcgcaatgatcatcattttgatcttagtctttgctgtacagctgtttggtgattggctcgttaagagcgtcacacatcattaaaaaaggggaaattagccgatgaaacgattagcatggtggttgattggtattgctgcaattgttggtatttgtgtgggattacatgaaataacgagttattcggcccgtgcacaacagagtgccacgattacggtcggatcaatggggtcggactatgaagtctggcagcacattgctaaaagccaagatgccaaaaagatgggcttaacgattaaggttaaacaaatcacggatggtgttcagctgaacaaggccacggcggacggtaacgttgatgtgaacgcctttcagtcctggtcatattaccaaacttataatcagcagaatcccaaggccaagttggcggcgttaggaacgacttatttggaaccaatgggaatctactccaaaaaatatcaaagcgttgatgaaattccggatggcgctacgattgcaattgctgacaatccctcacaagcttcgcgaggcttgttactgctccaaaaagcgggcctgatcaaactggcagccaattttggtgtcttaggttcagtgaaggatattacaagcaatccccgtcatctgaaattcaaacagatcgatgatactactggtccccggatcattaaaagtgtcgatgcagttttgatttcgaatacggttgctttggaaggacatttacacgttttacgggattcgattttccacgaaagtctgaataagagtactagggataatgttaatatcttagcaacggccgctaagaacgaacatcgtgctagctatcttaaactagttaaactttaccatcgggcggatattcaaaagtatatcaagcaaaaatattacggtactaagattaacatcaataaaccgctatcttattttgacaattaataagcatattgggtgctggatgattatagataagttatgattatgataataaatgttgtaactcatcgaacttatcaggaggtctcaaccatgtataaacgaatcctagtcccattagatggttccgataatgcttattatgcacttgaacatgcgattgccttagcgaaggtttttgactcccagttatttttattgaatgtcatcgatgttaatcgatttggcgtctacagtccagatgtttttacgagtgcggcgccagatatgatgagttttgatcaagcccagagtaagaaactgttggagcgggcccaggatcaagttgcagcccaccagttgcacgccgaaacaattcggcaaactggggtacccaaagtgacaattgcggtcgatgttcccaaggcccaaaatattgatttgatcgtgattggtcgctctggaactaatgcgatttctcgcctgttcttaggttcaacgacagcgtatgttgttcgtaatacggaggctaacgtcaccgttgttaacatgccgaatgatgaagctgaagaggttgaacaaaccggtgatgtttcggccgatgattctaaataacttgtcagtgatgattaaagctggtcacacgacgtcaacattgacgctcgtgcgaccagcctttttagtttgggacaggcgatgacgaaaaaacaaagtcgtctttcgctactgacgattaccgatttgagtgccaactgatgccgtttgggcgctagtttggttggcgtactggcttggtagctgattgcaggtgattagctgcaatcagtccaatgaatgtcaatgctaccgtcaataccgctagggccataccggcggccgcttcaccttgttcgaacgattgatagataaatgttgaaacggtcgtcataccggaaggcagtaacaatagggcaacgactaattcacgactcgtggcaatgaaagccatcacaaagctgttgagtagcgcgggccatagaatcggaagtgcaatttttaggataatgcggctgaaactaggttcgaagatgcgcgcgctagccagcaattccgagtcaaaggccttgagggcggtcgtcaagtattgcaccgttgttggtagaaataaggtgacatccgcgatcaggaggatggttagggtgccgtataatttggtgaacgccagcacctgtgaaaagagcatcattaagctcaatgctaagacgacgtttggaattgcgagtggcaatgcgcccaaggtatgacataactgtcgcagccacttgggaaaacgttttgttaaactcccaacgctcaagaataaaccaacgatcacattgagactgctaatcagtaatgccaatccgacggtcgtaacaatggcctgccaggcaggactatcaaagcgtaagaggtctatatagtgtacaagtgtcaaattagacggactccaaccaagactgcgttgtttgagtagcgattggagcacgatggcactgaatggcaggacaatagcaatactgatgactagggtgacgaaagtgcctgctaatgttgtcactccaagctgccgatattgtgacgctgaccgttgtccggtgaacttaacagctggccggcgtaacaaccattgctggataccccaggcaatcagggcaatggtcagtaggagggtgccggtgagtaccccgttttggaaatctaagggccactggttgaggtccttttgaatcgtagtcgtcagaacttcgaagtggatgctccgaccaaaggtggctggcgttccaaattcagccaaggttttggtaaagactaaaatccatacagctaagtatgggactaacatgattggtaatgtgattcgcactagtcgttgccaggtgttgaccccatgaacttcggccgcttgaagccagcgctggttgaattgcatgagggctgcgcgtaagcctaagtatgccacgggatacaaatgcagactcatgataatgaccatcccgaacggtgaaaatagccactgaaattggtggtgccaactcggattaagctgagccagtaatccgtgtggttgaaagaaatataaccagcccatcgcgttaatatatggtggtgtcatgaatggcactaacaagagccaatgcaaccaggcgagctttgttaaacgggtgtgcgtcatgatccatgccaaaggggtggctagcagggttgtcccgacgaccgtgcccccactgaggaacagactgtgttgaatgctcacacggttggttggctgcgtcagttgtgaccatagctggcttggcgattgcccgactagtgtttgaccaatcagggcgactaacgggccgataatcagagttgccaacaagcaactggtgatgattgataaggacaagcggatttgatgattactcattggctaaagacctgattgaatgcgacaacgtttttagtcagggccgcgttggcactggtccaattgaccgtgtaggctttgatggcttcgccattgcgtggatcggtcaaagtgctcgtggtacccggaattaagttacttttttgaatttgtctttgaactttagctgataagagatagtcaataaattgtttggcagcggcttgatgacgactagccttcaaaatcatcgccggtcgtggattgaccaaagtcccactcttaggataaacgaaaccaattttttcgccttttttaatagctgttagactcatgtaatcgacccgaccaaagacggcgattttttggccagtgatgactgcatcgagtacttccttgttagcacccccgatatcggcaccgttttcttgaagggctttaagtagttgcgtaccgtgtttcatttgataagcgttaatgaagtccaagctagaaccagaggtttgggggtccggaatggtcacttgattgcgatacggagtggttgtcaagtcagaccagtctgtcggtgccgatttgatgtgctgcgtattgtaggtgatgccgactgccgaagcactgtaattgatcaactggtggctagtatctttaaattgtttattcaggtgtttagcttgagaaggctgataggttaatagctggccattcttttgtaaatcgacgccagcggccattgaagctaaaatcagcacatcagcttggggattgccttgctcggccttgaccttacttaaaattttcccggtcgtgccgtcaaaacttttgactttaatgccagttttggcttcaaaaccgtggatgatttgatcagaaaggggtttaggtccagcagcgtatactgttaagacttgttgactggtttgcgcgttggcggttaacgtttttttctgatgttgattaacataaagcgacgtgccaattgcgagcacgccgagcgtggataatgtgataattgctgctttagacatgtgagtcaactcctaaaaagttagtatttgatgtggatcgatgcttaatgtgatcggtgcagtggtatagggtagctgggtcttgacgtgccaatcataggcgccgacttgaacgtaagtatcaaaatgatcgcccataaaggttgaacgctgcaccaagccttggtaagtgggctgctgagtacccgcttgactgactgcgacatattccgggcgaatggcctggtgcgcgttgatctgattaagggtgcccataaaattggcgacaaattgagattttggctgttggtacagctgtgctggtgtgcccgtctgcaccacgttgcccccttgcagtaatacgaggtggtcggcaacttgcaaggcttctggacggtcgtgagttacaaagatggccgtcagatgctggtcgtgaatcagggcgcgaatttctaattgaagccgtgtgcgcagttcggggtcaagcgcacttaaagcttcgtcgaataaaatcaaatccggttgggtcgctagtgcccgtgcaagggcgacccgttgctgttgcccgccagaaagttcacgtggataacgatgtcggaagtcaatcagactaacttgttcgagggcccagttgacttgagcagtcaattccggcttggtcagatgcttttctaaagcgaaagcgacattttcttggaccgtcatgtgcggccacagggcaaagtcttgaaaaaccatcgccaagtgccgctgggcagggggctgattccaatgagtcgcggcgtcaaaaatgggctgattatcaaatgaaatttgaccactgtcaggtgtcgtgagacccgcaatcatgtttaagagcgttgatttgccggaaccggacgggccaattaatgccgtgatttgttgatcaggaatcgtcagactgagttgattgattaccggaccttgaaaacttttggataattcgtgtagcttaatggcaaccacgatatgcaactcctttgtcttaattggtttgctcagtttattaagttactttgtattgtagtggtaattcgccgtgttaacgttgattttgagtttagtttatgtaaactttgtgtgttatttcggtaaaacagtgcacataaaaaaagaccactgaatcgaattcagtggtcttgggtgattcttattgtccttcagtcgtgttattggtatcagcggtcggtgtttccgatgaagtcgcttcggaacttgcttcggagcttgaactggcttccgaactactgctactttctgaactagattcagaagatgaactttcggcgctacttgaggaagaagcagcttcggaactactactgctactttccgaactacgactacttgcttctgtgctggtgcttgaactacccgttgttgttgaactagagctagctgaactagcggttcctgacgaggcttcactactggagaagaggtgaccaacaacgtaaagttcttcgataccgttcttcttagtcgtgccaactgagcttggtttggtccaatcagagtttggtgaatactgttgaaggtaattcatcatggcgcgataaatttgttgtgaaatcttttcgttggaggtatctagataaccaccagcttcggtggacttatcatagccagtccaaacggcgaccgaataattcttcgtgtaaccggccatccatgagtcaacgacggcatcggatggtactttgtttttatactgagaagcatagttgtcagtaccagtcttaccagcttggtaaacgccgctgatcttagcggttgtcgccgtcccagtagaactattgatgacccctttcagcatatcagtaatcatgtatgccgttgatttcttcatggcgcgcttaccagtgctagtatacgatgtcgtaacgccatcagaagtagtcactttacggatgtagtatggcttatgataaacaccaccgttggcgaacgcagcgtaggcaccggcaacttgtaaggtggaaacaccagcaccgatcccgttggcatagttaacggttttgaggttcatgccaaggttattggcaaaggttttggctcggcttttaccaacggcttgtaaggcccgaattgctgggatgttccgtgattgaaccagtgcttcacgcatcgtcatattgcccaagtaattattgtcaaagtcatgcacggaaatgttagtcccgggatatttgtatttcgtatcagacaacgacttgtaagttggccaattcaaatattcaatggctggtccataatcgagaatcggtttcatcgtcgaagcgtttgagcgtgatgtccagacagctcggttggttccgtacgtgacattaccggttttccgaccaccaatcatagctgagaccttgccagtgtatgagtcaacaaccgatacccctaattggaaagtctgttttccattattaggatagttgacgtattgagacgtgttggcaatgtcataaagccgtttctgggcatccatgtcaatgttcgtataaactttctcgccatcggttaaattataaccttttttgaggaggtcttgacggacttcgttcaggtaagcatccaagattttatttgtcttttcatgcttcgctaggcttgaacgtcccgaactagttaagcccgtcttgacactgactttttcagcagcagtttcctgactcttggagatgaccttgttatcgtacatcgcttccagcaccagattacggcggctagttgcgtatgatggataagtcgtcgggtcgtagtaggttggtgattgcggcatacctgcgagcagtgcgagttgactaaggctcagatcttttaatgacttaccgtaataatacttggcggcagtccccataccataaatcccgttacccatatagaccttattgatgtaaaattccagaatctgagatttactgtaatgtttttcaagattaagcgcaatccaggcttcctgcgctttgactttcaaatttcgatccgaagtactggtggaaaagaccgcaagtttaacgagttgcatggtcaaggtactcccaccttgcatcccgagtgagctaccttttaagttgccgactgcagccccaagaatccggtaataatcgacccccttatgcttgtaaaaacggcgatcttcgattgagacgacggcattcttaagtgtggatgggatattactagacttaacgtattcgtggtcgttagttcccaaagaggtcaaatacttgtcgttctggtcataaatcttagcggtccccgtattgacaaggtcactctgtttgactgttggtgccgtctgcgcatagtagaagaaaagtgctagaccagcgagtaccccgatgacaaacagtgcagctaaggataaaataatccgccgaaaccagtgtttcttaggtggtttaggttggctttttctgcgagcaacccgtgagttctgttcattgttacctgccatgatgttctcctttaatgaattgatgaggtctcatcaataatatgatcaagcgcatccaaatagggaatgcgtggattgatttgataatgtagctccgcggctaaatgttcaatatccgtcagtggaattgacttgcgaccaccatctccttgatgatcccaataagtaaataagtcgctggctgttaacaaaaataggcgccccaaactcgcaaaccgaatgataacaaaacagattccgctttgagctaagcactggcgcatgtgcttaatttgatgctcatgaaagttttttagcggaaaagccgttttgttcttggtctccttggcctcaaaatctaaatacttcccccgatagacaccgttataatcagtagtagaagcttgcttaaaataagcttcgcggattacagcggcgctgcgtttgggataatcgactttaacgatttgaatgggcgttggctttttatgaataactgcgatattattttcaagataataggcgttactatcattgatttcttgttccaagctcattccacgatcgccaaaattgacgttggcaaatttggaagatttcgatttagttgggccgggttggcgataaacttgaccgtttggatagcgaatcgtcacattaatcaacctcctaataatgttacattttaccattaactaatagggaatgtgaaatatctgtgactttttaactgatttagaccgatttagtgacagaaaggagacttttttatgagccggttgtggcttagtggttaccggagttacgagttgaatgtctttggtgatcaggatgataaactaaaagttattaagtttgcgttaactaattacttaacgacgcagatcgaggatggtatggattggctgataacgggtggtcagctcggtattgaacagtggacagcggaagtagggttaacgctcaaaaagacatatccagaattgaaagtggcaatgatgttaccatatggtgaatttggtgggcgctggaatgaaaataaccaagctaaattacagactttgctggcccaagtcgattttcatgcaccagtcagtaaacaaccgtatgaaaatccgcaacaattaaaaaattaccaagaatttatggttacccatacggatgcggccactctggtatatgatccagataaccccgggaaacccacgtatgactatgatttgattcggaactttagtgacactcatccgtacccattgaccctgatcgacttcgactggttacaggaaagtgccaatgaatatgcagaaaaacagaataatggttttaattttgaataaagtctgctacaatgttttaagtaatgcggatgccgaatgggtatcgcgcgaataacaatgaggtgtttttaaatatggctaaacgtaattttactcccaaagacatccttcaaaaagagtttaagccaaagatgcggggttatgatcctgccgacgtggacggcttcttagataatgtcattaaggactatgagtcatttactaaagataaccaacaactttcagatgaaaatgaacggttacgggccaaggttgacgagcttaccaagcaagtcgctgtcggtgcaaccagtccatcttctcaaccgactagtacggtgacgaatatggatattctgaaacgtttgtctaacttggaacgtcatgtctttggtgcccaattagataataatcaaaatgaatcacaccgtctataattgtgattcgatgtaaattctgggtaatcgcggtcggcttatgtcggctgaggaaggtccatgctcgcacaagctgcgatgcttgtagtgttcgtgctcggtgaaaaaataagccggggtaccgatttatcggtaacggcggaaaaaacggctaaggcttcggctatgcccgagtattcctgaaaagtgccacagtgacgatactcaattggaaacggttgagttggaacgcggtaaaccccacgagcgggcaacccaaactacggtaggggcgcttcacataaggaactgaactaaatgtggggggagattagtaatctcgagatagatgattaccgcctagttaacagaccctgtactttaactaggtacaaaacatggcctataggaatttacatttagacaggagactgggacaaaagttcgcttttgtcccagtttttttattcgatcagttagcaaactagcaacttatgctaaactaggtgaggaaaccaatttagtggaaatatttactcaacaagatgcgcctacagaacaggcgtcgcaggaggaaactatgcaaaaatttagattaattgccaccgccgctagcggaattgaagcattagtggggcgtgaattacgagatttagggtatcaagttcaaactgaaaatggccgggttcgatttaacggaacgatcaaagatattttgcggaccaacttgtggttacgaacggctgatcgaatcaagatcatcgttggtgaatttgatgcttatacgttcgatgagttgtttgaaaagaccctcgcattgccatgggaccagttattgccgatggacgctgaatttccagttgaaggtaaatcgcgcaactctaaactccacagtgttcccgacgtgcaatctatcgtcaaaaaggcgatcgttaatcagttagccgatacttatcatcggagcgggcaccttccggagacaggcgctttgttcccattagaagtggctattaataaggatcacgtgttgttaacgctggatacaactggctctagtttattcaaacggggttaccgagtcgaaaaggggggcgcacccttaaaagaaaacatggccgctgccttagtgatgttagctaagtggtatccggataatccatttgttgatccagtttgtggttcggggacgattccaatcgaagccgctttactggcgcgcaacattgccccggggttcaaccgcgcatttgcgtgcgaaaagtgggactgggttcccgctggcctgagtcaacaattgagagacgaagctgatagtttagccgattacgacactgagctggatattagtgggtacgatattgacggtaaaatgattgatatcgccaagctgaatgcgcgggaagccgggttgttgcatgacattcatttcaaacaactggccgtcaaagactttacgactgacaagatcaacggggtcctaattgcgaacccaccatatggggagcggctaagcgatcgggatagtgtccggattctctatcggcaaatgggccaagtttacagtaaattgccaagttggagcaagtatatcctgaccagtgacttagaatttgaagacttctatggacaaaaagccacgaaacgccggaaactctataacggtgcgttacggacagattatttccaatattggggtaaacgaattcggccagcacggacggaataagcaagcgacctttgttggtaaagaaagacaatttgtagctgacaataacgatcattacaatgtgtgatagatagtttgagtagccttaaaagagcgtgtttaatcgggtgaccgactaagcacgctcttttaaggctaacgttaaccatggttgagcctttgataattaatttaaataataatcgaagaaattagcaactttgttcatcagaggcactttgaccagatgtttggcttgataacccgtgataaatgccacttgttcagcatacggggcggtatgcacgcggtcaaagaaattacgagactgtgaataaggaatccgttcatcctcagtaccatgccaaaataaaagtggccgatgattgatggtttccggttgcaggttaagatcatagtgatctagccaactcgtcaatagggctaaatcactgggaatgtaataagcatgggcctgcgcatgcttgcggactagttgggcgtacgcgttcaggttaggggtccccataatgattgtggctgctttaatttcaggatgatgggtcaataaagccccggtcgtcatgccacccattgaataaccgccgacaccaatctgctcattcaaaatgagtttacgctcccggtagtaattcacaattagctcgaattcgccaagattaccttggatactgttccaaaaagtaaatgaaggaatctggctaacgatttggtgtcgttcaccgtgattcatggcatcgggcaagacgactcgtaaattcttgcgagccagtttacgtgcttgggtcaagacgagttctttattggactgccaaccgtggtaaaaaatcactagtggcagcggttggtctaaatgggttgtagtaacaacttccagcgcaggcacatcttgaaagtgtcggttagtaactttgatcatatttatcggctcactttattaatattatgattaagttaactgtgccagaaatgactgctgaatacaactgatagacttgtttagtcaatatttggtcttgttaattgttagtgatgttaaaataatggtaatcgcctgtttattaactagaattacggcctctaaaaagtaatcttaaaacggaaggtgttataaatgaccgaaatcgaaacggcactacttcgggaccgaaaagcaaaagtccagcaatattttgcgatgtgggtcactcgtgattttgaagcgttaccaagaatatttgcggtcgattgttattatcaagaatgctatggaccagcatatctatcattagcggaagttcaagcctggattgaacatcaattaagagttcaacgggtaacggcgtggtcgattcagcggttgtggtcagcaactgacaacatgatctttgctcagtggtccttcaccgctgttactgaccggatgactcagtttgatgggctttcggcagttcattttaatttagcaggacgtatcgacgatttacgagagtatcagaccacgactgcgcatgattatccttatcatggatccgtgctgtgatatgcgaagcatgtgtgtcataatgtaagcgaaatcattttgagcgttgggggaatcagtatgcaagttcaagtttctgttattgtggctgcatataatgaggagcactggttaaggcgttgtttgacctcattaaaaaaacagacattagcggccttagaagtcattattgttgatgatggtagtacggacggcacggctacaatttgtgaccaatattgtgcgcgctggccgcacctatttcgggttatccatcaacgtaaccaaggacagggacctgcacgtaatgcggggattaccgccgcgcatggccgctatttaggttttgtcgatgctgatgattgggtcgaaccgacgatgtatgcgaccttagtagcaacggctgagcgtagtcatgcccaaatcgtcgtttgtgatgttcgtaaaatctacgcggcgactcaccgcacaactagtctgctgagcttgccagatgcgactgatcatgtggcaattgcgacttatcttaaatacggtctaaataatgcttattccggaaataaattatatgcacgttcgtgttggcagaaatatcgttaccagcggatggtctacgaggatttagatattttgctggacatgttgagttgctgtgagcgagtcgcctatgtgcaacaaccattttataattattataaacatgctggttcgacaactttagattataccaacccacgactgtttgatattatgacagcctatcaagatgccattgagcacgccaaggtgacgtatcaggatgcggtgacttattgcgtcgctaagcgaattttgattaatttagcaacgccaggctttgccgattatctagcggagtttattgaactgatacgacaattgcgtcctatttttgaagccagtccgtcaataatgagtgatccggctattaaaaaaatttgtgattatgcaggtcaattgacattaccccggcgatttatctgtgagcgtgaggactgggctcaatcgtggcatcagtatagtcggaatttcaaaacgattataccggtagctaaagcattgccggccgatttacgacaacggtctaaccactttaaactcgattattggttgttgaaaacgttatttgaacaaggtggcttgctgattttgggtaccgtcaagttgcaccgcccgtttggccgtttacgggcgggaggtgacgtgttagcctttgaaggtgaacattgtttattagttggtgcgcaatcacgttccccactgatttctgaattactgcaacagttgattgttggttccgagtcactaacagagttgctgacaatggttaaggcacagccagaacgatggtcagcgggtacgcataagattcgcttggttgacataaaagattggctacaatagggcgacgggtcactgagtcatgcagagcagcggactcagtgacctatttagtcgttggttacattgaaaatgaataaaaaccaaataacaatttaaaatattatataatgatgataaaattaattttaaattaaattagaaaagggtgagaatatgttaaaaccagcaccattgcacgttggtgaccacgtggctgtcgtcagtctttcgagcggcacgctcggagaactcacgcagcagcatcaattgaatcgggggctaaaacggatgcgccaactagggctcgtcccagtcatgatgccgaatgctttgaaagggcgactgattttacagcaacgccctgaattaagagccgccgatttgaagacggctttcttagacccaagtatccgtggagttgtggcggcaattggcggtgatgatacgtatcgaaccgtgccatttttgatggctgatgagcagtttaagacggcggttcggcggtcgcctaaactgtttacaggcttttcagatacgacgatcaatcatttgatgttttatcagcttggactgcaaactttttatggccccaatttcttaagcgacttggccgaattagggccgacgatgttgccgtataccacgaagacttggcagcgttactttgaaaatcctcagcagacaagcattattagcagtcccgtgtggtatgacgaacgaacaaatttcagtgaatcggcgcagggaacacggcgcatgacccacaccgaaatgcaccattacgaagtgttacgtggtcacgggacaatcagtgggacgctacttggtggttgcctggacagcttttatgatttattgaccacgactcgttatccagacgaacggcaagttgcggaacagttcagactgattccatgtgcagccgaatggcgcggaaaaattctgtttatcgaaacgagtgacgaaaagccgcagccagatttgttcaagcggatgctgcaacgaatgcgacaagctgagattttgacaaacgtagccgccgtgattgtaggtaagccgcagaatgagcattattatcaggaataccgccaaattttgatcgatgagacagccgatttgaaattgccaattctgtacaatattaattttggtcacgcttttccgcgaacggcacttccatatggggcgcaagtgtgtatcgattttgagcaagctacgttaaaaattttagaaccttggtttgtggaagcttaagtggttattgttaaattggtatcggcagacgatcaaaaaggtattcgttgttcattgcaacgatcaaagaatagtgcaatacgagaggagttgtcatatgcaattacaaattcgacgttttaaaactacggatgcgccagcagcggcggcactgattgcgcgcacattactgacgagtaatcagggtgactatcccaaagcatacttggatcggctcattacccagatgacaccggcttggctatgccaaaaagctgctgcgacgcacttttatgtcggttattttcagcagcaactcgttgcgaccggggcgattgggtcatactgggggcgcccaggtgagtacagtctgttcacgatttttgttgatccggaggttcaaggcatgggtggtgggcgtcaaattctgcatacccttgaacaggatgtctatttcagtcatgcccaccgtgtagaaattccagcgtccgtgactgcgcacttattttaccaacacttcgggtatcgacctaagcctggaggaatctaaccggatgatgaaggcctgtatcgattagaaaagtttccacatgaatcatttcactagtaaatcacactttcctgcattggtttataatgtaaacaaattgtaaagtgactgcaatcagtttgagaacttatctgcacattttatcggtaggataaggtgtgcagtaaacgtacatatcaaactaatgatgggaaggcgagtaatttggtcatgcagaaaaagtggcggttgatactgctgctcgtgggttgttttttaggtggtatcggagtcgttcaggcacacgcggcggtgccggatatctcagagtggcaaggtcagttaacgagtaccgaggttcaaagtttgaagagtcaggctgattttgtcatcaaccgggtacaatatgggagcagttatgaggatctctaccacacctctaatgagagtctctatgtgaaatatggtgttccgttcgggtcctatgactatgcgacctttacgagtaccgcgactgccaaagccgaggcagataagttctatcaacgcgcaaataagaacacgaagttctacgtcttggattttgaaacgacttccatgagtagcacggcggccaacgcggctgtcaaggcttggtatactgagatgcggtcgttaacgagcaagaagttgattttttattcgtaccagtcatttgcaaccacatacgccaacacggcacggcaaagttttgatgcccagtggattgcaaattactcctcgaagccgacgatttcgttctcattgtggcaatattccagtagctattatttatcttcgctaggacaatatgttgataacagtttgtatgacagtgcttccgtgacgacataccacccgttaagctggtggacttccgggacttcggcatcatcgtcgaccagttcaactagcacgacgtatgcctacagcagttatacgaaagggcaacatgtgtacctcaataatggggcgtcgagctattatgacggcacaaaagtgcccagtagcgctaagaaaaaatactacaaggtcacagcaaccaagtcagtcactaagagtcgtcccaaacagctggtttacttaagtggtctgaataaatgggtcttatcacaggacgtcaccggctattgggtcggccaacacggattatatcaacttcgtgaaaagagcactttgttcaaagatgttaatttgacaacctcgacgggtaaaaccttgaaaaagggtggcatctacagtggtaaattggttaaaagtgggaatttctatcgaattaaggtgagtggtggttatatcacggcgaaggtctccaaatctgatcattggtactatgaatcagtaccttccagtggctggatcaaggctaaagtgggactctacacctataaatcttcaaactttgttaagtctaatcgacacgcttaccacgccgctggtgatcgaattaaagtaacgaaggtttactcacggtcgggtggctcacgctattatttaacgaataaagggaattacgtttcagccaaccgctcaaacgtggtcacacaataagtcaattaagtcgctcaaaacgagcatagccagttgattactaaacgactttcagcaagttattagctgaaagtcgtttttttgaggaaatacgtcgattggaagtacgttaagattaaaaagtgctacacttattttaattatattttaatcttgtggggtgggaatacaatgaaaattgggacattttctgcatcaacgccgattacggcattatcgccaaaccgttatgctcgcgcacgacggttcttggcaacccaaggagtgaccttagttgccggtaatttgacgggacgacgggatagttaccgtgctggttccatcaaagaacgggcggccgaaatcaacgcgttaattcatgatgattcgctggacatcttgatggcaacgattggtgggacgaacgcaaattcggtgctagcaatgctcgattacgagtatctcaatcagcatcccaaaacaattgtcggttactccgatgcgacggccgtgttattggcggtgcaaacgcacgcgcctaattgtcgtgtgatttacggaccggccttagtagcctcacttggcgccttagagtcagagatcgtgacaaccacttggcagaattttctgacagtctaccgcgcagcaccggggcaggccgtaaccgaacaggcaccggcacagtggacggatgaagcggtcaattgggagacctttgaacatccgaaacacatgcacgcaaatacttggcattatacggcgacccccattttgactggccgtttgatcggtgggaacttgaacaccatgtacgggttctttaactcaccttattttccaaaattaactggtaacgagcttttatttattgaagatgccgagaaaactgcagcaacgctggaaaaaaatttcgtaatgttagcgttggctggtgtttttgatcaaatctctggcattattttgggaaaacacgcgttgtacgatgatcaaggcagcgggcggttgccaatcgatatcttacaggaggtgctgggggatcgccaattaccaattatttacgactacgatagctgccatacagtccccatgctcagtacgccattgggggcggatgtccggattgatgcgcaggctcgaacggtgacgtttagtcatttttagactaccttttgcaattaaagacgtttagcaagctcaaaaactttgtaaaccggccatacttacatgcctggtataagaatacttgctttttgataaatgataaacatataataaaacaattagattaacaaaaggggtgtgatagtgatgcacaaatatagcgttcaagtgggggtctacacgcagtattttttaaggtcattcgggatactcccggggtgttaatttacacgatctgtttgccacttgtctttttaatcatgaatgtcagtagtgctttctttaaacctttatcgctgacaacttatacggctcaagtcgtgccctacattggttggatgattttttccaattgtctaacgactgccagcaatgtagccattcttcgcgagcagggttatctcaaacaatatcgaaccttggtggttagccccgcagtttttcttgtcagtcaagcgctggtcagcttgggtataattttgatgactttattgttggtggccctgttgagcgcgattactttcaagttggcctttttatcgttgctaggtcgcttatggttgactgtgttgcttacgtatctaccagtcacttgttttggcttacccttgattgccttggcactccgacgtaaaactgtcgatatgattggaaatgcactggcgctgatcgtcgtcgtaggtacctttatgttgagtaacatgctggcagtgtctgccaataacccattactcaacctggttagtcccatttacttagttaccaatgtttttgcgatgatcagcgtgggccacgtcagccactttatgacgacttatcttctgagtctgattgtattattggttatcggcggatttagctatcggcacattaagattctgccaacggagggcttataatgatgcgtgttgagcacttagcatatcagttttcaagaaatgggcaaccgttcttcaaggacgtgagttttcaattaaaaagtcccggtgtcaattttttgattggtcaaaatggcgctggaaaaacgacgctggctgatatcatcactggtttgcggccagcacaaggtgaattagacctacctaaagcagccatttatttgaaccaacaactcccgttactgtcttcaattcgtgtgcgggacgttgcccaactggttttgggcatcgagcacggacgactacgattgacaactgaacagctccaacaacttattgatacccaagcttatcaattcttggccccgttgtgggatcagcattatggtcagctttctgggggccaacgcaaattagttcagttattgctgttcttacaagttgatcgcgaattgattgttttggatgaaccaacagcagcggttgatcgggaaaacgtgcagttgttgtttcaggtcatgcaagcccatcctgagcgaacctacttgatgattacacatgacgttcgcgacctccatgcttttacagattaccaagtgttgtggctcaataatcggcaggtgacgacactgtccaagcgaacgtttgaaactgcgagcgcgcaagctgactttgttgcgctcttcaaaacgcagtaatataacagtaatggctcttgcgccgcaatggcgacacttattttgagtcctttggcgctcaagttggcctcgctggcaagtctcataaaatgacactaaaaaacggtactcagattagtttgagtaccgttttgcgtattattggtgagcgtacctagccaaagtaataaatataaccgatgatcaatgcccagataacgatccataaaatactgaatgccaacttgaagtaatacaaatgaaaacgaaaacggcggaagcggtcgctaccggccaatttgaacgtcaaggtcttattatctaataattgcaagtaatcatagaaacggggaagccacacaccgcccgctgttaacacgattaacaatccgatgacggcaaacgccgctgcggggtaaacgatactggtatcgaccgtaaaggccggtgcaagaatgttggcatataacaaccataaagcatacaaccccaacgcgtaaccaataatccgaacaacattaacgataattagccgtgactttaagtccggttgttgttgcatgagtgcccgattcgcatgataatgctgggtgccaaagcgcccgctgaccggaatcaagtatcggttttgatgtaagtatggcagttgtgctaacagcgtgatcaatgccacaactggtacggcgattgccaccaccattagtaggtactcaatggtgaccatgggaacggtgctgacccggtaggcccaactaatccaaccaatcaggatgaagacgtctaatgccaaaaccaaccaaatctgaaagcgacgatagtgttcgaacgtggcagtatcggctagctgccaatgatggtcttgagttgagtgaccaatcaagtaatcataactttgcgtcggccacactaaggcaggaatcattagcaagatgatgccaacgatcattaaggcgatgcttgtgacaacactccgaatcggaaaaatcaacagggttaattttgcgctgaccaagtagcaactgactagtaaactgataacaccgagccaccagcaagctgccattccataatataaccatttcaatcgtggtgcttgatcggtcacgtgttgccgcacttgatgttgcaattggagctgtgcgcgcggcgccagggttttagctggctggatgaccggatgctgaagattgtggtattccaaccaacccatgagtcctaacaataaaactaaaagaatccaaacaataactaacatggcaaaagtcctttaaaacaatatagtcgtgcgtattaataagtgtaaaacgaaaatatggtcaaaatgtgacgattatttaaatcttgtaacttttttaatggtcagttgatttaacgaagtggttaaaaaccattttctactgatcaattgtggactagactatgcatgactgattgtaaagctgtgttttatctgtaataaaaaagcatttggaactacttacgatgtctgtcattgtgggaggaaagtaatcatgaatcaattaatgacggaattgggacaagtgtactatcagtaccgaccggcgggaccacaacagccgacgttgatgtgcttaccggcgtttggctgggacgccactgattataattttaagcatttaatggcacgattgccaagtcaagtgggattacttgccatcgacacgattggtgtgggccgtagcattcatagtcaaatggtgcgcactgtcccgcatattttagccaatcttgaggatgtggttcaccatgaacacgtgagcaacttattattggtaggccacagtttaggcgctagttacgcgttcttatatgcccagcagcacttagacaatgtttgtggcttagttttgcttgaaccaccctatgccgcgatggcaccacaacttcttgcaaacgtccaatcttttattgaaaactatccgcaactagtacaacagcgacaaactttgacacttcagcaactcttagcagaagttaatcctttaaacctactggcagaacgtgtcgccaatgcccgtattgatttagcagcttacgcgaacccgagtattctgactgaagcgcaatgcttaccacaattagtaacaacgcttcgaaccgctgaaaagcgggtactgacgctgccaatccaagttttagtcactgaccaacgcttgacggcgtaccaacaatcaccgtggtgccagcttggtcacctagttcatgcaccaggtcagcattatttacactggacgaacgaaaattttgtccggcaacaactattgattgctctgtcccagtcatagggggcaaagagtcagtccacggtattaaattaatcgctgcaaagctagtactagcaacatctaccaatggtctgactttaatccaactgaatcagccacccgcaacaaattcgagtatgctaaaatgaaagcagattggttgtggaggcgttggaaaatgcaaaaacaagtaacgattattggtagtggcattgttggggcggtcacggcgtactatttaagccagaaccctgacctgaacgtcacgatttatgatgaaggtattggtcaagcgactaagaattcagcagggattatttcaccttggttatccaaacgtcgtaatcagcgttggtatcaactcgctaaggccggggctgctttgtatccggaaattgttgcggacacgcaaatgggctattctgtttatcaacaagcaggaacgattgtgactcgtgccgatccagatgatctgcaggcgctatacgatttagctctaaagcgccggcaagcggcaccccagatgggaacgattgagaaattaactgctgaagaagtccaagaacggattccactgctaacggcgccccaacccggtgtgtttgtgagtggtggtgcgcgggtcgatggcgataagtttgcacataatttactgaaatacgctgaaaagcggaacctggttcgtcataaaggtaaggtacgtttaggtgaccagggccaactattgacggttaatggtcagcaaagctatgacacgttgattttagcagtcggggcgtggctaaagccgttattgttgccaatgaagattgttgctgatgttcggccacaaaaagggcagttgattgaaatgcagctgcctgagacttgggctgacgatgttccagtgctcatgcctgaaggtgaacgagactttattccctttacgcgcagcaaattggtcgttggggcgacgcacgaaaatgatcagggctacgatttgcaggtttcaagtctggttgaagatgatctctttgctagcgggctcaaacttgatgccaacctgactaaggatcaaattacgcaggtaaaagtgggtacgcgtgcctacacgcgtgactttgcgccgttcttcggtccaattccggataacccacatattttggtagctagcgggttaggttcatctggtttaacaacaggacccatgattggtaagttgttagccgattatgttcaaactggtgctcatgactgggaccagtatcaacgaccaattgaaacttatttggccccggctgattagtcactaagatgtaagccttgttgtgctaattgatgggcgccatggttatcactttcggcaatccactgggtgattactaattggcactggtcttgcaggtgcagcaaagtcgccagctcgacactgaaagttttgctgtaacccttggcgacactttcggcgacgatttgactatccgtatagaaaaagacgctgacttgcggaccataagaatctaataaagttttaaagccagcaatggcggcaagaaattctgcggtatgattatcactgtctggcaagacctgtttgaattggtgttgttggccctgatcaataattaagattcccgcggcactgcgctgattatcgggtgtggtcgcggcatccgtatataattgcatcaaactcactccaatgtgaaaggaattttgtactgtgaataacgataagcatacctttaaataccaaccaatgctagcgtcaagtgtgatcgtctggtcgtggacggcgctagtattgatggcggggattattttgtggctagaaatcttgaagtttaagtggtggttactcgtcattgcggcgctctttattgccttggtcgcgattcaaatcagcttgcggcgcgtaacaattaatcataacctcattatttttagcacggtcttgaaccattcttggcttgtgattccccgtgatcaactcgaattgatcgtcccgatacgcggtgggttgaaagttcaaatcgatggtaatcaatatcggtttttgatgttgaaaaaggcgcgcaatcagttgattgacctagcaactagtcgatagatacgaataaaaacaatcaatatacaaataatgttcataatttcaggaagattgttataatggagtaagtaaaaacagaagggcggagaattgatgaaggatattgaaattgcacagcaagtgacaccagaaccgattacggcgattgcggctaaagcgggcttgacggttgaccagatcgaccaatatgggagcacgaaggctaaacttaaattaccgttaccagttaagaaaactcaacgcaaccttattttagtaacgtcgattaacccgacgcctgctggtgaaggaaagtcaaccgtgactattgggttaggtgacgcgttgactaagattggtaagtcaacgatgattgcattgcgggaaccttcattaggaccagttatggggatgaagggtggcgccactggtggcgggtactcacaagtgattccaatggaagatatcaatttgcacttcaccggcgacatgcatgccctgacggctgcgaacaacacgctcgcggccttaattgacaaccatattcaacaaggtaaccagttgggtatcgatcagcgtcgaattcaatggaagcgcgcgttggatattaatgatcgggcgctccggcatacggtgattggccttggtggtgcaacgtcgggtgtacctcgtgaagatgggtttgacattaccgtcgcgagtgaactgatggccattctctgtctttcagaaaatatcgcggacttgaaacaacgtgttaatcgaattgtaattggctacacacatgaccgtcaaccagtgacagttgctgatttgaacgtcggtggcgcgatcacgttacttttgaaagacgcgttacgtccaaatttagttcaaaccctggcgcataccccagcactcgttcatggtggtccgttcgccaatatcgcgcatggttgtaacagtgtacttgccacgcaagctggattgaatctagccgactatacggtaaccgaggcgggcttcggtgctgatttgggtggtcagaaattcatggatattaacgtgccagcggtcggacaagcgcccaatgccgtggtaatcgtggcgacgattcgggctttaaagttacatggtggcgtggctttgcaagatttggcaaccgaaaatgtggcggccttgaaagccggtgcggctaatttaggacatcatatccatgccatgcaacgttatggggtgccagtcgtggtggccatcaacgaatttacggccgatactgacgccgaaatccatgccgtcaaagactattgtgccgatcttggagtcgatgcagtcttggctgatgtctggggtcgtgggggtgacggggcaaccgacttagctgccgcagtggttgatttatgtgctcagccaagtcattttcaaccgttatcaccagcggatgcggatcttaagacgaaaatcaacgatattgtcactaagacgtatggtggagccaatgtcgaatattcagcgaaagctcagcgccaattgagaacgtttgctaagcaagggtgggatcatttgccagtctgcatggcgaagacgcaatactcattgagcgatgatcccaaacgtctcggagcaccaaccggatttacaattaatgttcgtgaatttgtgccgaagttaggtgcgggtttcattgtcgctttgaccgggaacgtgttgacgatgccaggactgccaaaacatccggccgcactcgatatggacattagtgatgatggaaaaatctcaggtttgttctaaagcttgaccgataagtcgatgccagtgggggtcggctttttatttgcgctgtttttggaagactgcgacagcgaatcaatcacacacgtttaatttgtgagctaccgatgatgactaactcgcttagcagttgagcggtgcaaccaatcatcaggctcgttgcttcaactgggggatggttaaccaggtgccgatgcttttgggaggatactcgaaaggtgcttagttattaagtctgcaataaaaaccgcgcttttcctgccggagtttcgtacaaggacgacgtcttttggtataattaaacacagcttagcgaaatgtgaggacagaatatgtggatctatttaattttaatggtagcgctggtcattattgaccaagttatcaaagcagcgattgtgagtcatattgcgttgggtgccagtacgagtattgttaccgggttattatcactcacaaatttacataataacggggctgcttggagtatcttagaaggcaagatgtggttcttctacttgatttcagtgattgccttgatcgtgatgggctacttgctgtggcgcttacgtggcaaatggctatatgaggttggtatttcactgatgattgcgggaactttggggaatttcattgaccggttacgtattgggtacgtcgtcgatatgttccaacttgattttattaattttccaatttttaactttgcggattcatgtttaaccgtgggcgtcatttttatcttgatcggcgtgctgcgggatgatagttttgaaaaataagttacagggagctgataacgtggcaggagcgaccacggaacaacaattcacgattactgaccaaacagggcgcttggataaagtgttagcggcactacagtcggtctggacgcggtcgcaagttgataagctgatcaaaacggatcaggtgacggtcaatggtcagctcgaggcgagcaagtatcacgtcaaaccaggtgacgaaattgtcgttgccgcacagacggttcaacaaacaacgattgagccagaaaacattccattagacattgtttatgaagacgatgacgtcttggttgtcaataaacctcaggggatggtcgtgcatccagcccctgggcaccctaaccataccttggtgaatgccttgctgtatcatagtccgttgtcgacaatcaacggtgaatttcggccaggaatcgttcatcgcatcgataaagatacgtccggattattgatggtcgcaaagaatgaccgggctcaccaatcgttagcggcccagctgaaggcgaaaactaacttacgagaatacgtcgcactcgttcacggagtgattaaagaggatacggggacaattaatgcgccactcggtcggtcaccgaaggatcgcaaaaagcaagccatcgttaagaccgggcgaccagcagtcacccattttaaagtactgaaacgttatcagcactatactttgattagttgccggctggagactggccgtacgcatcaaatccgcgttcatttacaatctattggacatccgctggtgggcgatcccctgtacggccccaaaaagacgattaaggggcacggtcaatttttacacgccaaattattgggattcaagcaccccgtaacgggtgacttattgacctttgaagcaccactaccaccaatctttacgacaaccttggctaagcttgacaaaaccgatgggaatcattaatctaacagtaatgagcgtcctttaatccggccctgcgagactgaaaggcaaactgttaacaataacttttcgtcgacggccgtgacaccttgtccggccgtctttctttgtcgtacgggttgctcaaaaaagcgataaccacaaattgggaggcaattatgcaaaaagaagttgttgattcaatggcgatgaaacgggcattgacccggatcacctatgaaattatcgaacagaacaaaggcattaaaaatgtcgtcttagtgggcgttaaaacccgcggcgtctatattgcgcagcggattgcagcccaattacaacagcttgaaggtactgcgattccagttggcgagttagacatcacggcatttcgtgatgatcagccgctggatcaagcacggctttcaacggactatcagttaacgttttcggtggcggataagcgggtcattttagtcgatgatgttctatttaccggccgaacaattcgcgcggctttagacgcattaatgggtggcggtcggccccagagcattgccttggcggtgctagtcgatcgtggtcaccgcgaattgccgattcgcgctgattttattggtcgcaacattcccaccgcgcgtcaagaacgcatcaaagtgacggtcaatgaaatcgacggtcacgatggtattgaaattattaactagtacgacaaagtcaaacagatgagaagggatcgcaatggcagaccgctatttgattcttgaagatggcagcgcctatttaggtgaaggctttggctcgccagcggtttctaccggagaaatcgtcgtcaacacgagtatgacgggctatcaagaaattattactaatcaaatttatcataaccaaatcgttgcttttacgcagccaaccattgggagctatgggatcaaccatgatagctacgaatcaattttaccgaccgttaagggggtcgttgttcgggatgtcgctagcatttcgaccaaccggcagcggcgctggtcactggatcaatatttaaagcaacaaaatattcctggcatcagccatattgatacacggcacttagcgaagcaactccgagcaagtggcccgatgaaagccagtatcgtagacgttgcagatgcccatgcctttgatcaattgggtgcgaccgtgctgactaatcaacaggtggcagcggtcgcaacaccgaaaccatttcctaatccggggacggggctcaatgtcgtggtcatcgactttggcctcaaacacgggattttgcgcgaacttagtaagcgtgcttgtaacgtcacggtcttaccttatacggcaacgactgaggaaattttaaacttagatccagacggcgtcattctatcgactgggcccggcaaaccgcaggacttaccagccagtgtgactgagatgatcaagaacattcaaaatcgggtgccactgtttgccatcggactgggccacgaactatttgcgatggccaatggcgcccaaattatgaaattatcacctgaacatcatggggctaaccacccaatccgcgaagtgattacgaaccaaattatttatgcagctcagggccaggggttcgcggtagatgcggatactgttgatcgtaataagttaatcacgacatttgttgacttgatcgatgggacgattcaaggactgcgtctacgggactttccagcgttttcagtgcaatttttcccagatggcgctcctggtccgactgaaacgcgcgatatttttgatgaatttgttgagtcgatgcaacaagcaagggggccaatctggtgaacaatcaagccttacaaaaagtgttgattatcggcgctgggcataatgacattggccgagagggacaacacgacgcggcggtgacccaaatcggtgcggcaattcggcgtctgggcattgctgttgtcctcgtcgataacaatgcttactccgtggcggctgaaaatcggtttgctgacaaggtttatttagaaccactgaccgtcgccgcactatccaaaattattgaaactgaacagcctgatggcctcattccttcacttggtggcgtccaaacagtcaccctaattcaagggttgattcgcaacaatgtgttaaaaaataatcacgtgaagttgctacagtgggatcaagacgtggtcgacatgattgtcaacccagcgctgatgagcaaccggttgaaagatatgggtgaacccgtgattgcctcacaagttgtggctagcacgactgaggcgatggccgtggtgcgccacgtcggttttccagtgatcgtcaagtcggtcgcaccccgaatcgaagcgagtcgccaactatgtgaagatgaagacgaactgcaacgggcactagcaatgggattcaaagtttcagggaccaaacaatgtattgtcgaacagagtatcgtcggctataaagaactcgaatttgtagccgtccgtgatcagaaggacaccgcgctactagtcagtgggatggaaaattttgatccagttgggattcactccgctgattcaatcgtttttgccccaacgcaaacgattacggatcaagaataccaacagtttcgctcagcgacactcaagatcatgcgcaagttacacttgaccggctcttgtcacgttcaatttgcacttgatccgaccacgcaaaactattacgtgattaaagtgacaccgtactttgatcggacgatggcgttagccgcgcgggcaaccgagtatccgttagcacaagttgttggtaatctaatggtcgggataagtttggcagaggtcaaactgcccggagcctaccgtaaacaaacagctttaattgaacccgttttagatcatattgtttgccggataccagtttggccgtttaatgtgttgaagaaagttagtcatcaactagacaccgtgacggaatcgacaggctcagtgatcggtattggtcgttcaacggaagaagccttgttgaaggggttgcggtctacggacgaatctcgctatcacgtgattgctaatcgaccccagaactattcggagggtgaactgatccaacggttgattcatccgcaagctgggcgcatgctgattttacttgaagccctgaatcgtggttatcaaatcgatgaattagccgagctaaccaagattgatgctttttacttttataaactgagtcatattttagaaattgaacgagccttgcgtgaacggccgtttgacgtccacgcgctgggccgagccaaatattttggctttaccgatgaagatgcggccgctgcctggcaaacggatgtggctaaggttcgcaactttgcgttggaaaatgaaattcaaccgacttttaaggaggtcgaaccgactgccggggaatttactgagcagacgagtacttattactccacgtacgaatttgataacgaaagtcaaccgtctactggtcggcgagtcgttgtcattggcacgggtgctaaccggatcggaaccaaccatgggaacgactatttggtctcacaactgttgttctacttgaaaaaggctgattatgagcctgttttgatcaacgctaaccctaatagtgtggcgatgactccgcgattggccaaaaaacgttacgttgaacctaaacagtattcggatattttaaacgtcttagcgattgaaaagccgttgatcgtttttaccacctatcatgattaccggctgggccagaagttagtacaggatggctaccaagtgatccaaatcaacaatagcttgccgcgcgagcagatcaagaccaacgattcgcccgccgtcgaggtgattacggacggcaccgatgtgacaatttttggggtaagtgaaattattgcgggaaataatttgcgtggcaatgtccgtggtgcggtccaagtatttccgattcgtgataaggcggaaaatcaggcaattacagctttacacgctgaaatcaagcaacgagtgctcgtcatgggtgcgcccgggctctatacagttcggttagcaattgctgatacggctttgcaacttgctacgattgaaccgatgagcattgctacgatggcgttaatcagtaaggccagtgggtcgagcgtgacccgcttattacttcacgtaaaattaggcgaagcactgactaaggtgatgtacgactatccggatgttaaccggctaaagccagtctatgttcaggcgaatacatttccctacaatcatttacaaatttatgatgaagtggaagccaccggtgaaccgggccatgctaccggcacggtgattgcacatggcgacacgttaaaggcggcgttgacagcgttgaatcagggaaatgaagatacggatttttaggcgtaattcagtacgtactctgatgtttgttgaatcacaatgagtaatattaataataaagatgctggctttttcttgagattggtgtgagatagtatttcaagaaaaaccagtttttattttgtcgtcaagctaaattattagtcacgttgcccattgcatatggtacttaaagctgataagcaagtggcttggtgaggtgaaagtagcttttaacactgatagtcactagtatcagtgtttcaaaacggatataatgttattttagagcgcttgataagagttgctcggagatgaaaaagggacattggggaggaagcgtttatgcgtaagaacaaagcggcaattatcgtgattgcacttgccgtgttgttaatgtgtagtccattgttattaaataatcatgcgttactgggagtagatgggtactttcaatataaccgaatttatgaagctgccctgcaactgaaaaatcataattttagttttattaatctttattcattccagcaggccggtcgagttgtgaatagtttatatagtccattaattacctatgtagctggtgggctgttgttactggtcggcaactggtttagatttcaaatcttaactctttttatcgtctattttgtcagtggctatgtgatgtatgcagctggtcgccggttaggtttttcaaaacgggtgtcaatcgcgttaggcgtcatctttttgagctctaacgttgtttatggattcatttttggtgttacatggcgctcaattgcttttggattactacctttattggtggggccaattcttgatttatatgccggtgattggcaactattatctatgttgaaattgggtgtattcattggcttgctggcccaatttcagattttaacggtcgcgttagtattaccgttattggtgccattttttatacgtggtttatggcattccaagtttaatttgaatgggctgttaaacttttttgccggtgtcttattagccttgttgctcagtcttaatacgctgttgccattactggaagtctatcgtggcaacacgctaatttcaccagttgcgatggatttagtaccgaatgccagtttgattttgcagccaatctacaatggggtggcttctaatagtgatattgtcttaacaatgattgcttatgcgatgctcacaggattgattgttttctggacccggttaggtgcgttcaccaaattattttcttgtgtcgcgctagtttatattcttattggaaccgggctatttccgtgggactcgattcaaaagtcgatgccttacttgcaatcgtttttacaaatgccacgacgaatttctttggttgggacaccattcatgatgctagcaacggttatgatttatcaggatgttgcagttagtcaaaaaagcgcagcccttcataagggaattgtgattgctggaacttttttaagccttttgtcgttacttttatgtacgcaaaaggttgctcagaatgtccattatacgattactgatacaactccgttagcagcaggattgcagacagcagacgataatgtccattctaatttgaagtatattaagcaattacaaccggcctttcatacacgacatattaatcagctaattaagcaagttgatcgcacgacgccggattacattccggtgacgcagaaaattgaaacccatagcaatgtctatcgtgcataccggcgtaacttttcagtgcaacagtccaagttcaaacatcaagtcattcataatggcattcagttgacttggaatgcgaagcacactaaaatgcgtgccttgcctgtagttgcttatcgacgtacggtgctaactttgaacggtcaccgggttacctctgaacaaattaaacatcattggataggtaacttgagtctaaaacagcgacgtggtaagaatgtgctaacggtaagatatgaagctagtcgcgtcacaacattaggaacgaagcttgctttgatcgcatgggttggtgtattagtggctgggccactgcttgtcaaacgtgcacgtcgatttttagtggcttaatcaatatatttgtttaaagcacggccggataccaatctggccgtgttttttggctgttgagatcgtaacgaaacctagttgctcggctttaaatagcgctttcatttatggtatgcttatctaaagacaaattaaaggcaggttagttaaattggcaaagacactatatatgatgcggcatggtgaaacactttttaatcggctgaagaagattcagggggcgtgtgactcgccgctaacccccaaaggaattgcggatgcccaacgcgtgggtgcgtattttcaggcgcaagggattacgtttgatcatgcgtacagctcaacgcaggaacgagctagtgacacgttagaattagtgaccaagcaaccttatgagcgtttaaagggtatcaaagagtggaattttggcgttttcgaaggtgagtcggaagtgttaaatccaaaaccggaccccgtgcgccgcagtcatggtgactttttctgtcagtacggtggcgaaagtgatttgcaggtacaagaccgcgttgtcaaaacgttgacggcggtgatggcacgtccggatcatcatcaggtgttggcggtcagtcacggtggggctagcttcatgtttttgcggcaatggctttcaatggacgaaattgagcggcaaggcatcgtgttacataactgtgcagtcatcaagtaccagtatgacgcgggccgcttcacatttgaaaaaatcattaatttggctgcaactgataaaaattaaaattatgtcaactagatttaagtgcgttgacaatcagtctgagtttaagcattaaaaagcgctcacgactcggattcaggcatgaaagcgaggtcgtgaacgctgacgcatcaagggcgccaaaaggtcgtcatggtttgtttagtagtcatattatattgaatgatttctgcaagtagcttgtgattgattggcgcatcgaaagcaacttgccataacatcttggttgttttatcaccagcagccgtgatcgcgttccgatagctatccaaagtatgtgattcaagtgcaatgttcagatgatccttggcggtactgaacccaatgataaatgtgttgtggtcagtaaacatcggttgattccaggcgacccgtgccttgagttgtggaaaagtcgtgtgtacccagttgagcaaggtaatcagttgggcgcgatggggtgttgcacccagcttttccagatatggtgtcaaaacagctaggtcagcgtcaaggtactcagccattggcattcctccattcattgatggcttcagtgtaccggatacccgcagagcttgcaaccaaaaataatcccgttcaatcaggtggcccacacggctgatcgaacgggattatttttaataccgcgcatttgagcccactacgattcagtgcacggttcgtttttattagttcattaggttccaatgccagtaaggatggcgatcgactctataaatgacagctggatcagcactccgaggccgcggttgtttcactgtgatcgttaagacttgtgaatgacgcatagacatcagttcctttcttaattaatatctttagtttacccatttgaagcagactcaactactgcgttttcataaggctagcataagaatttcttagaattgtactggcgagggccggcactacttggacagtggttacggtgtggttgcttgaagaaaggcataatctgatgagcgaacaagcaccggtaaataacactgattaagctagtggctcattcgcttcaaaaaaagacctgacgagcggtgtttaagctggataacaaatgcgcataacgggcctcgactatatggttaggctaagtattgtgttggttgttcccaacatgactggagtttattaaaaaaatgactgagatgatcgccatcaatggtggcatgattgaccgtaatgcttagcggcatgattgttttgtcagcgtccttcttaaactggcccgcctgaaaaattggaaagaaactatctagtggtttggatgggaggggcgtgtagctactaaagtggactcctggaagacagccgatattaaccagattaggtgtttgtggtgttttcggcatgggccctggaagtgcactaaattcagcttggtctgctaaatagtgttgatagaacgtttcaaaatcggtgtcgtaagtcgtccataaattggccattgtccggtcagcgtgtaagatcgtataagatggatgtcacacgtcaaaggtcaccagttgatcgttcaaatagccgatgcgcatttcgggatgtgtggtcaacaagcgactcactaggtatagatataccgcgttgaatttaacgtggtgggctttagtccaagctagggtggcggtaatatccatatttaccgtgagactaaaaccgctgggggctatcttggtgaaatagtaaaaataagtttggcgcggccaggccgcaggattaatagcaacggcgtgcatgtttggtttagtggtggtcatttagttttccttccaatctttagggcgctgattatagccatggtcatcgaatggttgtaaatcgtgcagccatttggttttgagtgctttgagcgtggcacgcatattagtgacatcggtcgtttccttttgccacagaatttgatatgaaaagtcagcggcagtttgttgattccaatcagcctgtaatgggttggaccggtaaaagtttttattgagatttagttgataaaaggcccagcggttgtgtaaattgggcactgtgtcaatccaaattttatgattgcgttcgttggtaatttgaatgacgccgtaataagttggggcaagtttgtatttttgctgtaagcgatgtttttcgactggttgcatggttcagtcctccttagtagttgtgcgccagtattgccggccatcgacggtacgctttaagaagccgtagtcgatcaggtaacggcgcagcgtggtgtagtcaaaataaatcggtcgtaaatagtggttgagctcgtcttcattgattggtcggttcatcggaatttcatcaataatccgcgttagaatggtgacaatcgtcttttgctttttgggccaccgcttcaattgtagtgggtcatgatcaaagttgaagtactgcttcaatgtttgggtaacttcgtcttcagtaatcgcaaagcggtcatcaataattccgggttgttctggcaggacaatcaaatcattaggcgtctgaccactctcaaagacggattgatagatggccaggtacaatttagcttgtttggctttttcacgaaatgtaaatttttgatgtcgaatcgtggccgccgctaattgaaattgtttagccaagtcggcatccttgatgccagtcgcaaaagcagtcagtaaattttgctgtttagtggttaaagtattgtagcgactcgctaagtgaatcagtggtgactggataccaccatggacgatcgttaagtgttgttcgatcgtggccgccgctgcagtcgtttcccagctagcatcacagtaattacaataccgggcagtggctgtttgatgccagccgcgttttaaatcatcaatcgttaaactagttaagtccatgaggctacctccaatgttactgattataagactgtttactgtatttgtaaacacaatcgatgaattaatgtttactaaaatagtaaacttacaatcatctgatatgtttaccgttacagtaaacgcttaggtttgccttgacaccaagatagctagcgcttacgcttaacgacgctgtttaaacgtgaaaggacgtgggacaatggaaacttatcaccgtgcatttggtgtttatgggattattggcgatgagcatgcgttggtcgttactaaaaagtttggtggtccctatacgaatcgctacgacttaccaggtggcagtttggccgatggtgagcccttacttgccgcgattcgccgtgagattcaagaagaaaccgggttaatcccgactgaattgacgcaattgggtatcacgagttttcggtatccctggcagttcaagcagtggcgaatgaaccaacatctggcggtcttttaccgagtgacccggacgactgggcagctggctgaacatgtcgctaactttgatggtcaagattcgcatggagcatcacgggtgccgttgcatgcgttgactgaagctaatgcgtcaccgctggttttaaaagcaaaggcagtgttgttatccgggcagtttgacccaagcgatcagacctacccggactggaccgtgctggatcatccggtttattgacctgagctaatcccggaatgtcgccaaaaatttcatttcaaaagcgaaaaataggtgaacactaggttggcaatgtggctgatctagtgttcacctatttttgattcatgcgcacaactaatgcgtttaagcgggcgtgtggcttagtcctaatgtgacaaaaatgacgacgttgattgattagttaatcgtcgttttgcgtggtgggggttaaaagtaacaaaatactggtgtgcgcccgagaaaaccaacatttaaatgaatagcgagctataattcagtaacgtccgaatggtaatctttcctaggcagggttacttatcgtttaaggagggacgcaacgtgtcgacggcttatgagaacgcttgccatcttgaaagagaggggatttaaatggccgatgcaattttaaccgttaaacatctgaataaaagttacggccaccagccagttttgcgtgacgttagttttgaatgcacccagggacggatcgtgggcctggtgggcgcgaatggcgctggaaaaacgacaattatgaaagcaattttagggctacttagcacggatggtgagattcaaatagcaggtgaatcgatgcaattcgatcatcatcccatcttggcgacggtggggtcactaatcgagtatccgagtctttatccgtatatgagcggttgggacaacttgcgtttgtttgcggacggccccgatgcccaagcgcgattggcggcggtggtgttcgcactaaacatgaccgactatatccatcaaaaagcgcgtcattattcattggggatgaaacaaaagcttggtgtcgccctggcctttttgaatcggccgcaactagtgattttggacgaaccgatgaatggtttggatccacaaggtactaaggagttacgcgattttatcttgaagcaaaaacaggtgggcgtcacgtttttgatttctagtcacattctcagtgaattgcaaaagttagcagacgatttagtcattatcgatcacggtaaaattattgagaaaacaacgatgacagcactgttaacgacgaccgatcattttgtcactgtgaaaactgatcatgacggtcaggcgaaagcggttttggtggcggccggctatcaagtagttgccgacacggttgtgaaagtccacttagcaccggaccatcaggtagcagatgtgctccatgttctgactagtcacggactgacggtcagggatgttcggcatgaggcggctgatttggaaagtacgattttaaaattactggcgacaaccagcgcctagggagtggtactgatgatgacgttatatcgacaagaactcacaaaactatttaagaagaagtccacgatttggtgtggactgatattggctaccatagcgctgatctttgcgattttggcgcggatcaagccgacgatttttcacgccaaaaccatgtttgccgctaattttgaagcgcagcagttcattgtcttctttatggtagcagcggcggccacgatgatcacgatggaatttcaatttgggacgatcaagcacgtgttaacgcagcgttattcacgaccactcgttttggttagtaagtggctcgtgctgttaacctacagtctattgttgtatgtcggtagcagtctgtttgccatcttacttaaagtctgcttagtaaatgataaatttgcgatctttacgcgggccaagttttggcatgattggttggcgggcgttggtggtgaatttctcaatacgtggttactgctaagtctagtgctgctaattgctgctcttttcaagagttctggtgcggcagtcgcggtcggaatcatcggatactttgttctgggaatggttaatattcccatgatcgcactcattcggaagtatacgtggctcaaatggaacccactcaacatgttcaacttttcagcccagttgggattaccgacgctgagtaaaattaccaagctcacggatgtccagttgttttggggcaatcttgcatacattattttattcttagtgttaggcctgctattctttcggcggcgggaagtttgaaccgttaccgtttgaagcactgccagtaaataccaaaaatcgcgcgcccagaaatttcatcttgggcgcgcgattttgttggttaataattgataaatatgcgcttttgaaactagtttacgcgtgcggtgtcagttgttcaacgagctcagcattgggagaaacgtacaacgttttctgaccttcatagatcacaaaaccaggcttggcgccattgggcttgcgaattcggcgaacttggacgtaatcgaccggaacggttgctgaatcgcgggcttttgagaagtaggcggcgagattcgcggcctctgtgagtgtttggtcactaggatcatctgaatgaatgatgacgtgtgagcctgggattttttgcgtatgcagccaatagtcactcttacgggccgttttcaatgttaactgatcgttttgccggttgtttttaccgacaaagatcggcgtcccgtcactcgcagtaaattcctggggttgactcggtttacgtgaactgcgttgctttttcttagtcttgtgttgctttaagtagccttgttgcgtcaattcttcacgaatttcggtgatgtcagcgggactagcaagctcgatttgggtctggatattgtccagataatcaatttcagcttgggtcaagctgatctgctcaccaacgaagccaacggcatttttttgcttctgataacgtgaaaaatacttctgcgcgttccgggaaggcgagagctgattagatagttgaatctttaacggcgcgttatcgtgataatagtctggtaaagtgatctcagtcatcccacgtttgacttcatgtagataggtcgttaagatttcaccttttaaccgcagctcatcggcctgcttggtgttagctaaggttttttccaactttttgagcttattacgattcttcttcaggttatttttgaccacccgaatcagattgccggcttgttgttgaactcgttcccgttgggctgcgtctgcataataaaaatcaagcagactgctcaatgagtcgaactggcgcgtggctttgccaaaatggtcaaacggtcccgcggcaaacatggtcttatgatttggtaaggtgatcaacgtcgcctgcggctgatcaaactgtgccaaaaaggccagataatggtgatcaaggtcgccaggctgatgcaagtcggcagctaactgttgcgcgctatcacggccgaatccctgataatgatgctgcaattgttttgccaacacgtcttcgttggggtaatccgtgactaaggtgtgaaaatcagtattcggtgtaaatgggtcttgtttgtcttgcttggggggctcgatgtaggtcgcgcctggtagaagtagtcggtagcgattctgatccgcaccgacatgcttgatgacgtcaatgatcttaccagtctgattatcaactaggatcacgttactatgtcgtgccatgatttcgataatcaacgtcaatgtctcggcatcaccgagttcgttacgggtcgtcacggtcaggtgcacaacccggtcgttggcgacctgcgacacatcggtcacgatggcaccttgtaaatatttacgcatcatcattgcgaagttcgtcggcacggccggattaacgtaagggatttgtgttgtctggatccgcgggtacgtcgggtcagccgatagtagaactgggtgattcttccggttggcacgaatggtcagaatcaactcgttttggtatggctgattaatttttgaaatacgaccgccaactagtgtttggcgtaattcggtgaccatggcatgggtaaataaaccatcaaaggacatgtgatcactcgctttctaagatattcgttatcactgtaaaaatacagttaaccgggtactagtataccgtttttgaacggttaaaaacaagttagcgccccgcgttgacgcataaagttaggcgctgacgctgctagttgtcaaacaagcaattagcggatgaccgctttgaatctaaaaatgttatatgcaaaaactactttaacggtattttaaataaaaagtagtcgtaattacgcactctatattgtataatacaaatgtattcattgtgtgtgctgctattcgcataagtgatggttaaagcgtgctaattacgatggaatcgcactggatcagccagtttacgctgaaacgtgcttgcgtcagcaaagctcagttgagtctttttgattctaaaaattgggacgtttttaatcatcaggcggggtaaattaagtcacaatggaccgatgtgaattattgttgagaggaatgaactgtcatgaagtcaagtttaacggccttagcggaaaccgctaagttgcaaactgccatgttgaaaaaaattactaaggcccaaggaatcaccgttgcggaatggcaactgctgatccagttggcagcgggggccaatacgcaagaaaaattggcgacggccatgcagcttgatacatctacattaagtcggcaactggctagcctagtcaaaaaagaacgtttgagtaaggaagcgattggtcgtgaccgccgccaactcgtttacacggtcacgccggcaggaacagcgtcattgaccaagattaatgcggattatcaacagtttgaagcagaagtttttgacaaatggccacaagatgaacaaaaccttctccggattctgctcaatcggttaaacaagtcagttagccgaattctcgagccatgactttccaaacggtcgaaggtagagtataacttagttttatgctatgatatttgttattatttaaatgagaagtaggtgtaagtcatgaagattgctgttgttactgacagcacgagctatttgacaccgcaagaggtcgcggacaacgatattcatgtcgtgccgattccggttattatagatggaaaagtgtatcaagaaggtgtcgacattaaaacggccgacttttacgcaaatatgaaatcatttaagtcgttcccaaatacgtcccaaccacccgtgggggaaatggtggcattctataaccgcttgggtgaacaaggttatgatgaggtcatcagtattcatcttgctagcacgatttccggtttttataatagcttgatgaacatgcgagatatggtcgataatatcaaactttatccgtatgactcccagattacggtccgtctgatgggctatttggcaattgaagccgcgcggatggctaaagctggtcacagtgttgaagaaatcctggcacgcctagatgatctgcgggcctcgatgggcgaatactttatcgtggatgatttgcaaaatctggtccggggtggtcggttatcgaatgcgtcagccttcattggaagcgtgttacggatcaagccactgttgacttttgatgatcagagccatgaaatcgtcgcctttgagaaagttcgttcaactaagaaagctttagcgcgagttgagcacctctttgctgaagcacagtcaaaagtcgactatccgctgcgagcaattatcgttcaggggaataatttggctgccactgaagattggaaacaaaagttacaacaaatttatccagacatgccgatcgatatcacgtactttggtccagtgattggggcccatttaggtgacaagtcattagcgttagcctggttgaaggacattgataaggcctactaaaatgaaaattattttttcagcatcaccagccaatcgggcagcggcctacgcgttacgtcaggctgtatttgttgaagagcgtggaatcagtgctgacgttgaatttgacgtcaaggatactgatcagcgtgaatatgccgttctttatttgcaaccagatttgccagttgcaacgttacgcctagaaccacaaaccgaccacgtgatgcgctttggacgggtctgtatcagaaaggcctatcgcggtcatggttggggtcgtcaattattgacagcggctgaggagtgggccacgcaacgtggttttactcatggcgagattcatggtgaactcactgcccagcgcttttacgaacggtgtggttatcgagttataaccggtccgtatgatgaagatggggcccccgttgtgattatgcataagcaattattatgattcaactcgtagcgttggcattttgccaacgcttttttagggttttgccgttgactaacgggaacaaaacacggaaaatggactaaattaaacaagtagtggaggagtggcgcaatgattcaaaaaacgagggtcgaacttaaaactgaaattaagcaactttttaaggggcgctggaaagatgccatcttattatgtattattattagcttattgacgattttcggagtgatggccaattattcagatcgcatgtcagcgggcagttctacgtctgacagcgcagcctttaaacagctgggggcactgacgggtactgatatatcgctgattttagctgtaatggccggctttttactggtccaagttggtgttttgttggtcgttcaaatctttcggattgggacgagctacgcaatgttggactgggtccgtcaaccagaacgccagatccatccagtcagcgactcaacgatcgggttcacgaagcactatggctgggcgctggtcggtttgattatttataaaacggtgctcatctttttatggagcctgctattggtcgttccaggtattattaaggcgtatgcttattcacagactttttatgcgtataaggacttgttagctgcaacaccagctgggcaatcccgtccccgctatcgggatgcggtcacccgtagccgtcatttgatgtacggacacaagtggcagttattcgtgttacatttaagctttttaggttgggaaattctcagcatgttaacggttggaatcggccagttatggttgacaccttatatttatggggtgcttgccaactattatgataatttacaagcaattaattaatgaacgtcaatattaaaaatcgacacaaataatattgtttcttttattaagcattaagacaagcccgccaaaatatggtaaactggcggaagcaagaaaggaagtgcgatagttaatgcctgaacaaaaacagacgcgcatgtcacgcttaaaagcgcgagaggctacgggtggcaagcggggacgtaaggcgagttcgcagggatcccatgcacctaagcaaccgaacgatccaaagaaaccgcaagcacctaagtcaccgcaaaaaaaacatcacgtttcgttatggctattggctctaatcgtgattgcgctcgggggaacggtcgtatactttgtcaaagccgctagcaaccaagacttagttgaaacgacgagttcctcaagtagcagcaaagcgcggaaaaaatcatcttcgaagaaagcatcgagctcatcgaagaaaaagaagaagcattcaagttcaagtagtgaaagtactagcgaaacgacggctgcaagtacggatgccgacactagcacagatgggacagaaacgacgggtgcgtatagcagttcaactgccactaatacgaccgctggcaatacgacagctagttcgcatagcacgacggccagtcatcaaacgaccaccagtagtgccacctctcacagtacttcaacagctagcagctcatctaagagtgagacgtcatcaacgagtactgagaagagcagcagtagcagtcactccggctcgacatacgataatttagatgacgcgaaggactatggtgaaaactcgatcaatgggaactataaggtcacgacggatagtaatggctcgtaccacgtgtcaaaagctgattaattttaattgcaatcatgatgtttgagctgggcttttgcgaccgttttcggtataatagccttaaaatgattgtaagaagtgagtgataaaattgaatcacaattatgtggaagttaagtatccagccatttttcgtgatgaaggcacctactgggatgtccgttttccagacgttcctgccgcccagacctttggggcgagtgtccaagttgctgcggacaatgcggcgaacgcgttggctattgcgctctttgaacaatcactcccgccggcgtcggatccgcagtactggcggttggcttcaacggaatttgttgtttggatcacgatggcggatgtccagtttggtccgggcgctgatacaccggaaccaatgaactaatgcgtataaaagggtctatgatatttagtgttgatggataaaatccatcaacactatttttatgtacaacaaaaggacatatcgtcctgtgctacaatcaagtcgaccaaaaccaattgaaagcgagtgtcagatatgtcccaagaccattctactaaagtactgctccaaattaaagacccaaatattactgatttagttgttcaagaagctactaacggaagcttacaagtgcttgcgaagctaacgtatccggttactgtttgcgcacgttgtggcaaacgttccatggttaagaatggctttaagaccgttcacatcagaattcctagaattagcgaacgggtcaccatccttaacttaaagaagcagcgatttatctgtaaaaattgtggtaaaagtagtttaacaacgactacgctggttaaaaaacatcatcaaatatctgaaaacagtcttcatgccattgatctatcattaactgaagaccgtacgatggcgagtattgcggctcaatacaatgtctcgaccaatacgattagtcgccgaataaagttgctcggacaaggtacccaaccagctttcaacggactaccaacgatgctttgtatcgacgagtttcgttcaactgataaacaaatgagttttattgcggtggatgcccaaacccacgacatcattacaatattaccaggacgtaagaatgccgatattaaagacttctttctcaatcattattctaaacgtcatcgtgaccgcgtaacccgggttgtgatggactttaattctcaatatcaacccgcgattcgaacactctttccacacgccaaactggtcgcggataactttcatcttgttcaaatggccttacgatctttgaatcaaactcgggtccaactcatgaaacgctttaaccctaagagtcgtgaataccgagtgcttaaatattattggcggttatatttaaaagattatgacagcctcgaaaagcgcaaaccccaatggtttgtgcatcttaaagatcgcatgacacaagagcaattagtcgtagccggtttaaatctagaccaacagtttcgacaaacctaccaagccgcacatgccttagttaaggcttttcaaaagcgtgattatcgatccttcaaagcagcactaggtcatgtcgaaaatatcagtcctcagctaatgaccaatattaaaagctttatcaagaaccggcaactcatcaaaaatatgactaccggccgattatcaaatggtcccgtcgaaggtgtgaaccgtaaaatcaagcaaatcaaaagaaccgcgtatggttacaagaactggcaaaactttatttatcgaattcaaattgagttcaaaatcaaaatcgaaaaaaagaacccaattcgtaaatgaattggattctaaatataacttcatcaacaccggttgacagagacccgtataaaaggcaaacgggtcggcacctaattggtgtttcggacccgttttcttatttcatgaaagaagttgagaaaccttgccaaaccagccactaatctttgatacggccattgcgaaggataagccagaaaatatccggcacccgcacaatgcctgtcctttttgcgatccgggccagttgactgatattatcgcgcaagatgccgatcgtatctggctattgaataaatttccgaccttgcaagctacctggcaaacgatcgtgatcgaggcggcccgccatgatggcgatattgctacttactcatccgcacaaaaccgcgctgtcttcgcgtttgctctgaagcactggcaagccacaattgcgagtggtcggttcaaatcggtgttgtgctataaaaattttggcccacactcgggtggaagtttacggcatccacacatgcaaatcgttggtttaatggccgccgatggttacgctaacgtgacagcagccaatttgacggggtattcagtgttggcggtcgatcaggtccaagtgactgtttctgatcggcctatcatgggatttgtcgaaatcaacgttgctgctccagctaccgcgattgcaccgttagccgatgctgtgcaacaggtcgtccagtatacgctaaatacgtattttcatgggcagtgtgatagttataacctatttttctatccgcgggatgaccagattgttgccaaagtggtcccactatttaatgtctcaccatactatatcggctatcggctggcacaagcagatacgccaaagcgaatgcgcgccatcgctgaggaaattcggcaacagtttgaacgatcgaatctggctcactcaaactagctaataggccgaacagccccaaacgacggaaaaggcccccaggaatcctttcgattctcgggggccttcactttaccgttcacgtgtatgattaatggtgacgcaattgcgattagtatctggttgcggggtggtcaaaagcaaccggtcaagtcgtgggggaacatctctcagcagtaatgtcagtgattagttatggttttcaatgctggacggcccttcgccgggcatagccgtaaagactcagcaaggcgatcaatgtcagcaggccacagctaccgaaagtaacggcaaaccccacccgttgaattaaccagccaatcagaggaaaagcgctgatcatcgctaaactaaagaccatgctggcaacgctcagtagggtggcccgttgcccgtttggaatcagctgattgtagtagttggaaaacagtggctcaatcagtgccatcaaactattgatgactaaatagatgaggaccagtagaccgatggcgtgactaaatgcgctaagtagggccataatcatgcttaggcagagcccgtaaagtaactgatgttgggtttgatgtcgctgtagccaaggtgtcagttggatcgccacaatattgagggccatactcgcaatgaggatcgtcgtgattagtctcccactaaagtgctgagcagtcatcactgtttgaaagtaatagtaataagttgttccgagtgccgaaaagagcgcgtcaaagatcattaaaagccgtaaacgacgttgagtcactaacagatgcgcggcagcacgaaggatcgttcgtaacgacggttgtgctgaatgagtcttggtcaactggcgctggggaacgcgcagtccactgattgccagaatggcaatcagtgctgccgctaaatagacccagtacgtcactgaaagatgctggggcattaaccagccagccaacacgacacccaacgtatcggccacttcgattgtcgtgttgagaatcgtcgtgacgcgtggataatgttgcgtggcctgagtattgacgagactgtcatattgtgccgcttcaatcgtaccagactggagattatacgcccaggcttgtaggatgaatgctaggagaaaccagccgagactgtgagccgtcaacatgatgagggcgtgtccgatagccatcaggcggctaatgatcaggacaggccgataaccaaagcggtcggcgataacgccggagggaacttctgagagaaaactagtcagatgaaaaacactttcgcatagccctatctcaacgagtgataggccttgttgctgtaaaaagatcacccagagggtgttgataccaaaaaaagcacaggccgcataaccataactgagggttaggttacgacgggtaagtggtgataacatattggactcctttagcggccacgagcggacaaaaaaagacgacccattgtcgtcagctgctcgtgacttcgcaatggctagtggtcattcaacttggaaaaagcgcagactgcgcccctgacataaccataactgcaaaaattgtgcgcttaaggttaatccaagctaaaaatttagccaacacgtcattcaccactttctaataatctcattttcttatcataacaataccatatcaatttctgactgacaactgataccgataagtttgaatgcctgatattagttgtgattgtggtatgatgttaagtaaatgaacaaaagtggaggaataatcatgcaaaatttgattccaggagacatgttggaagttaatcaaaaacttaagtgggaattagacgcgggaatgactgcggatgaaagtagcgtgattaatgaagctgtgctggcgggaactcagtacttcgtcgatgaggccttagaaggtagttactggacagttaagtgggctgcagatggtcagactatcgaactctatgggacaactggcaccgtcgttggccgcattaaaccgctgtctgccacgttagaaaatgattttcgacaggattcacaaggcttgtttattcggattgaaaaagaggtcgcagtgattgttcgtgataactaagccgaattgagtaatgaggtgattagcatgtttgatcaagatgaagaacggtttgcaacgctagggttagccgccaagctaccgagcgcggtgattgatggcatttgggatattattgatcaaaatctaaaaggagtcgttcgcctgccacgggtcctgcaatttgccctgatcgcacgtaatgggcaagtcaccgtggcttttgatgcgcagcacgatgccatcatggaattcgatttaccagtcaattaccaacgggagtttcccgagacggtggcagtcttagacgatggtcagtatcagaccatgatgttgatggacgaactctccgtctgaacgcagcgattattcaatgagctgaatacgaggaaactcgtcacttcaggccggcgaataatcgctttttgattggtggtctttaactgggcagatgcgccttaaatttgtataattaaatagatggtgtgagttgtggttttgcgatgtcaggttccggttgctaatcaaggaggccgcgttgttcacgtaattctcacaccgggatcagagaaaggtgtgtgtctaatggcgaaaacagcagtgtgcattgtcgatcaacaacgttaccaagttgtggacggtatgcgattagaagaattggaaactagtttgcggcaaatgattttaaaagattttccgcaggcccataatagcagtttcatttgtagtgagcatctcgtacattatcgcttagcaaagatggatgcgatgatcgagaacgattatcaacaaaatgataaggtcaatgcgcaattatctaagattctcgctaaccacacgtatcgggtcgtcgatgttaatagcgagctggaaagttcattgacatttggtcaacgggtcgcggatggggtcgcacggttcggggggagctgggcgtttatcatttcgtttgtcgtggtgatgctcgtgtggatgttgctcaacgtcttaccaatttttagccatcattttgacccttatccctttattttattaaatttatttttaagcatggtcgcagcaatccaggcaccattgatcatgatgagtcagaatcgggcagctgagtatgatcggctacaagcggccaatgattttaaagtgaactcgatgtctgaagaggagatccgggtcctgcactcgaaagtcgatcatttaattcaacaagatgaaccaaacatgcttgaaatccagaaaatgcaaacacaaatgttaggtgagattcaagcacaagtcaatgaattacgacgattgcaaccgcggcgacgtcgcaatcaaagttaaggtggctgattgagtagttaaccaaaaaaactgagcgcctggaattttcacattccgacgctcagttttttggttaaccgtgaccgcacaacggcattcaatggcactcgtcaagattgccaacggtcagtggcactatttatatttactttctaaagcactcatccagtaccccagcgcgattcccacagcaagagctatggcgctgaataggtaggtactgagtgtggcatgcgcatatgagatactctcagccgcatgtggattcggaatcaatatcagcatggtactagccagaacaatacctaatatgaaatggtagactcgggaatgaaacttcactaataggtgatccatcaacttcgagaacaacgccatcgccaggatgccaccgatggcgatcggtaagtagacgcctacgatatctagtcttttaaagcccgtcagcatgggtgtgaaaaggcctaaaataagtagcaagttggaaggactcagtcccggcactaagacgcccaaggcaatcagcgctcccgcaacgatgaaaccaccaaagttagcgggcaaggtcccaaacagctcactcataaagtaaagtaggccggcactaataatgaaggtcccgaagaaccaaactccgtcgagccagtcacgtggtgcccgactagtcgcagttttcatcagggctggtaaggtcccgatgatggcccctgcgaacccccagagaacgatcacctgagcgtgtgcgagtaagtattccagcggggcggaaagcagggcaatcccgacgatgcctcctaatccgacggggacaaagtaccagaagtcccgtttaaagttacgacggaagtgggccataaagcccaacagtcgctcgtaaatgccgagaatggcggcgagaaccccacctgagacgcccggtaaaataaagccgagggcgatgacgacgcccttgaagaatcgtttccagaaagtatcagttgttttagttggcataagtaaactcctttagctctaatgactggtattccagtaataatcaaagtaattaaagataccagaaaaaatcctgcatggcaattaaaacccgttttttacggtttccttcggtggcaaaagttgcacggcggattattttatcataaaatgaatggacgtgaaaaaatctgtatttttatgaaaattattatcaaattggattaaaggaaagttgaggtcatatggaaaatcagcaacttgcccgtaaactaaaacgccgtcacgtgcagatgattgcgcttggtggcgcgattggaaccgggctctttttaggctccggttcagcgatcaaacaggcggggccgtcgatcttgttggcttatgccattggcggtttcttctgttacttgatgatgcgagcactgggcgagctattattgtcggatacgcgtttacattcgtttctagaattcattaatcgatatttaggtaaacgtttcgagtttgccattgggtggacctattggctctgctggatcagtttagctatggctgacttgactgctagtggtatctacattcgttactggtttccgtggatcccgcagtgggtgacacctttaataattattttgattttattagtattcaatatgctctccgtcagtgcgtttggcgaactagaatattggttttcgatgattaaagtggtggctatcattgctttgatcgtgacgggggctatcttgattggttcatcggcccatgtcggtgggcaaacggtctcggtgacaaatttggtcagtcacgggggcttcttcccaacaggcgtccagggcttcttgatgtcgttttcgctcgttatctttgcgtttacgggcatcgaaatggtcggaattacagctggggaagcggaaaacccagaaaaagaattaccacgggccatcaatagcttacccattcgaatctcattcttctacgtgggcgctttattcgtgatcatggcaatttatccttgggatcagatcacgaccagtcagtcaccctttgtgcaagttttcagcgacgttgggatcaaagccgcggccagcattatcaacttcgtggttctgaccgcggcgctctcggcttgtaatagtgccatcttcagtacgagtcgaacactatttacacttgcgcacggtgacaacgcgccgaaatggatgggaaaggtcaatcgttacaacgttcccgcccgctcattgttattctcatcattgatcttattggtgatcgtggcgttgaattacgtgattccaagtaccgtcttcacgttgatctctaacgtggcaacgaccaacttcatcattgtttggtgtgccttgttggtgtgccattacgtttacaaacgaaccactgacagtacgcataatccgtttaaactgccactgttccctgtttccaacatcgcgaccttggccttctttatcgcggtgacggtcgtcttgtgctttgatcaagtcaaccgttgggcagtcatcggttcagtcgtttggttcgtcattttattagtcatcgaacgaagtatgcatcgcaccgtttaaaaacgataattgtaatcaccggtcatcagtcttggtaaacccaattagtttaccagctaatggccggcgatttttgtaaggtgcaataatcccccctaatagtgcattctattctataattaagtcaaacatcatggacgttgctgacgaccacgtatcagccgtgacatgattattggggaggggaacagtatgaattatcgcaacttgctcgtattaccacttgccgtcttgttggtcggctgttcatcaccaacacaccaggattccaagactagtcagacgaccacgagtgccaaggcaacggtcagcagcacccaaaagaagactaaggctaccagtagtactagtagtcggcctcaagccgcaacaacgcactcgtctaaaacagcacgtgagcgggccagcgctgctaacaagtcggtcacccagcccacggctacgagccggctggcagcattgaatcaacaattgactaagacgttgggaaagcaggcgctcgttccacaagtcgatgggttaactagtggcagttcgaagttgaacatgcgctatttaggtgacgcagccaattacaccatcaattatagtgtgggacaacaggcccagccattcaacgcggcggccgtggtggatgaaacggcttatgcgactgtcactaagacgacctatgcgacaactaatgccgcggcccagcaggtgggttatcgtgataataaatccacagcagggctgccaaccgtcgatctcggtcatcaaatcaccgcgcatatcgacgctggtgctggtcaacgatatatcatgtggaatgagggccgctggtcgttgaccgtgcatgcgaacatgatgcacgaagatgcgggcgtcgcgttagctaaacaggccgtcgctactttcgagcaggtctacttaccagcaccacagtcggtcggcgccatcacttttgacgcgatttcgtcaggctctggacctttagaccaagttatccaatggcaagctggtaaagtggtttatcaagtcaaggctcaagagatggcaacggctatcaaaatggctgccagtatgcaataatcaataactagtttctacgctcgttaaattaagcagtgagctgacaaacaaaagtagcagcgtaatcagccagagatggctagtacactgctacttttgttggttaggcgttattttcatctcattcgactgccagctggtgaatcgcgactattgatcagtcggagattggcgcagttgttgttcgatgggctgcgtcgcttttaagataagtgcttggtcactcagcgagatgatacggtggtgggtgatcacggcagaatcagttaatgcttggtaaacagcagctgcaaccacccaacaagtatcggtgtcgtaatcacgcgcatgcagtaaatcataaccgtcactcatatctaggtagacttgaaagccgatacctagccgcgcctgtaatcgtttcgcataacgttgataaagcgcgcgattggcctcagagtcgggggtcggcccgataatccgttcaccgagttgtaagtttggcactaagcgcacttgcatgtcggtgcctcctttgcgttgaaaattataatcctattttagtctaatccattcatgaaataaaggcactaatcagccgcagttaaggtgattagtgcctttatacgcattcagttaagctaagagacgtaatagtagccacccggcaacgccaattaacagggcgtaacccagacctggtagtagtgttttacgtaagatggcgccttcttgaccactcaggccaacgactgagctgacagcaacgatattatggacacagaccatgttgccggctgccgcaccgacaagctgggctgccaagataatcgtgggcttcaaactcgcattggccgcaatatcagcttgaatttgcgcaaaagtcagcgtcgagaccgtggtactaccagttacgaacgcccctaattggcctaggaatggtgccatgatgacccaaacaccagctagataggtcgcgataaacttggcgatatacattggcatgctgggtaggttggcttgattcaagccagaattagtgaagacttgaaccatgatcagggtaacaccgagggcaattgcggtgttgcccatcgaacggatgaccgaatgggcagttggtagtaagggctttaatgaacgggcttgtactagtaacccaatgatggccgctaccgccaagattgtccctggcgaatagaggagttcccaatcagagttgatttgactataacctagaatgtgggaccacgataagttagcataacgggtcaaaacctgtttgattggtgtcacgacccggctagcgagtaatagcacaacgaccaacaggtaaggaaaccaagcggtcatcaggttcatcggactaggcgcaggcgtctggtctgccatcccgttcgtccgccatggcgtcaactggctcgactttggtaacaaccagtgcaatcggatcgtgatgatggcaataaccagcgttcccagcggtgcgatgattgaaacaaattcataacccactagccaagcactgaggagtgccagtagactgtaaacgaaaccgatcactaacgcccaaggtaagacggaaagccagcttttcaagcggtgtgccttagggccaaaccacatgatgagaattaaaatgagcaccgctggcattagcgcaccaacgaataaatcgagttgcgtgatgcgcaggccaatcaagttcaagacggatgctttttcggtcacattactcagtcccacggtcaatggtgttccaacggcgccgaacgctgcgggggtcgagtcagccactaaggccaagataacggccgccatgggtgaaaagccgagtgcaattagtaatggtgcagtgaccatcgctggggtcccgaagcccgagacaccttcaatcaagcccccaaataggaaggctaccaaaacggtttgtagccgcatgtcagcagacaaactttgaaagccctggttaatccggtcgattgcaccagtggcacgcaaacagttgagcatgagtaaggcgccaaataagatccataagatggggagggctttatgaatcgcctgcaaaattgaggcggtgaggaccgttggactaatctgccagaaaaagtcgccggtaataatcaccaccagagcgctaatggtcattccacgggtcgcggataaattcaggcccccgagaagaatcagtggcaggatgattgcagcacttgcaataaaaatcatggtcgtaaagcctccttagatggtgcctagtcgtttgactgtgctcgtttgaaataatactgaccgtagagcgtgaccagcgtaacaatcagagaaatcgccgttaagggccaaaccatccctactagataagtgttcttcaaagcggttgaagctggattgaagaaattgagcaagtttaattgtcgaaaactgctaacaattactaagaggccgaagaaacaaagttgacaaagcaggcccccataagtggaaaagcgatatttatgaataattgcgagatctggatcatcaacctcagtggcataaacgctagtattaatggctgggttttcaaaaccgacgtacaacgagatcaggagcaaaccggcaacgtataaaacgggttgggccgtggcaactaacaaatggccgacaatcaggccaccgcgtgcaatcgtggtggcacgatgtaagtcatgccgtcccaataataaatatagtggccggccggtctcaaagcccaacaaatagatggcgaagaccaggtacatccccattttgccaaagacaaagacaccgaagaaactattaaacagtaggacaaaactcagtaaaaagccccgatcaacgatccgtagtttgttagccggcatggcctgccaatcagcagctagttctagatttagtagaacaatggccacgacgataattcctaatacggccggtagtgcgatttgtaggctcgccttacgaagcaacgtcagtaaaccaatcgcagcaaagaagacgataaaaaccacaacgcgccacggcttgacgggacgtacttgggccatttcatgttgatcgtaaaatgcgagcgaaaactgactcagcaaacggccagcaggcaacgcaatgataaatagtagcgccagtaggataaaggcaagccggtaaccccagttcagcgcaaaatctagcacaaagagaatgccgagaattaagaaaatcaaccagtaaattttctttaacttaaaatccgtctgcgcggacaagtgtaacttgatcgtcaagtaatagggccagatgttggcggatgtatatcctaagaatagggccccagccagcacggccacgatgttagccgtcaaactgaacaacaagctaccaaacgcacccagccagaggcaaatgagcaaataactactagccttgaggtttaggtgcttagtcccaaagacgctcgccgcccgggccacgtagaagaccacgatcgcagctaagtaattcgcgttgtgggtctgctgatacttaaagagaattagaacgtagggtaggacaataccgacgttagccaagaagttaagcgtcgcgacagagaagtccaacccagagtttcgtagacgagtcaaagataatcacaaccatttcgttagtttttctaggcctagtataccaattaattagagctaatgctgacaaaaggatatgtcggccgtaacatcgttagaatataaatagcatgatgagttgcaaataatataattatgtaacacgttactttaacttaatatctaaacaccacaaaacaatccaaaaaccgttatcaattgaataaccgtcaagaacagttcataatagtagtaacctttatgctaaaaattactataccaaactagatttaagtctaaaatacaccacatatcttcgagtagcaccatcgctgtgtcgttatgtatactgcaattcggcaaaaaattaataattctttattattttcctcttgtcgacagggtagtacttgtattaaattagatatgttatggtagtgaacgtactatatttgtaggctttttcttaacgtagccatgttttattttaggaatagcgaattatgtatcatactattcttgtcttgctagtgtttgacttaataaggacaagttcataaaaaatccataattctcgtttataattgtttaataatatgtaccatgaatggagtaatgttgatatgatttatgctcagattttagctggcggtaagggtactcgcatggggaacgtcccgatgcctaaacagtttttgaccttagcaggcaagccaattttaattcataccgttgaaaagtttgtactggaaagtcgctttgatgcgattttagttgtttgccctgccgactggttgagtcacacacaggatctaatcaaaaaatacatctcagacgaacgagttcacgtggttaccggtggctctgaacgtaacgaaactttgatgaagggtatcgactatatccaagaaaattatggtagccacgatgatgacatcgtcgtgactcacgatgccgtacggccttttatcacgcaacgtatcatcaatgataatattgaagcggctttagagcacccagcagttgatacggtggtgccagctattgatacgattgtgcaaggaacagaaggcaaaatcgacgatatcccagtgcgttcaactatgtatcaggggcaaacaccacaaagttttaatatcaaaacactagttgaatcttacaacgccttaactgatgcccaaaaggaaactttgtcagattcttgcaagatttgcttgttagcaggtcaagaagtgaccttagtgcggggcgaaaactataatttcaagattacaacgccttacgatttaagagttgcttctgctttagtagaaacgagggactaatatgttaaatcaagtttatcgcttagtagatcctcgtcagtttgaagtgcaaactgttgctgaagagatcaccaataatgatattattgtgcggccacgctttttatccgtttgtcatgcggatactcgttactttacgggtcaacgaccacaagcgaccttacggcagaaattaccaatggcgctcattcacgaaggcgttggtgaagtcgtcaaggatcctcaagataaatttaagccaggaacattagtggcaatggtacccaatactccgtttgaaacagatcccatcattaaagagaactatttaccatcttctaagttccgttccagtggttatgatggcttcatgcaggagtatgtgagtctgcatcgggaccgtgcgattgtcgtaccagataactttgatcatcaaatgtctgcttttattgaaatggtctcagttggtgttcacgcgctcacacaattagaaggcgtcatggatgctgatcgtaaagtcattggcatttggggcgatggtaatttaggatttattaccgcaacccttgtcaagcaaatttttccagacagccaactcatgatttttgggcgccatcagtctaagctcgattatttctcatttgctgacaaaacctatttagttgatgatattccgaatgatttaaaggtcagccaagcactagaatgtactggtggccgggggagcgaatcagcaattgctcaaatcatccagcatatccgaccgatggggacggccattttgatgggcgtctcagaagatccagttggcattgacacgcgttccgtgcttgcagaaggcttaacactacgtggcgtaagccgaagtggccgcgctgattttcaacgagctgttgatattttgacggatagccccgttacacgggaacggttgcagaacttagtgggcttcactcgcaaggtcagcacaatccaggacatcactgatttctttgaaggggccttaaccaactattggggcaaggcggtgatggagtgggacgtttaaagacgttaaagctaacgctattacgcgctagctttaatcttttataccagcttttttactttctaggtggtcctaggaagcatcgggttacttttgcaacgatgcgaagtaaccagttaactgataatttgaaggcgctacacgcccagttcgaaaaagatggccagatggatattcgcgttttttgttatcattatgaccggacttttaaaagtaaactcggatttttagtggcgtcaatacgggctttacacattattgctcgttccgaaatgctgattattgatgattatttttttccactgtatgctattaataaacatgctaataatcaggtcgtccaattgtggcacgcaattgggtctttaaaacgttttggtttaagtttaccaacggcttcacaaagtgtgcttaaaccacatacgaattatgattgggtctttattaattctgaaattgataaacctgcttatgtggatgcctttgacgtcgatcctgatcacgtgattgccagtggcgaaccgatgatggacgaattaatgcgccagcaccctgaaacacactcgggtaataaacgcatgctatattcgcccacttaccgaccaggtatgcatggtgaggcacaggttctggcctatgtccgtgaatttgtgaatgccagtcaacaactacaggagccttgggatatttatatttcattacatccgtaccttaagttaccaaattggcatttaccatcgcatgtacatgtttttcaggatgcgactcgtgttaagcaaattatgccaacaatggacttgtttattacggattactcgtcattatcacttaatttcagttactttgaacgtccaattttactctatacacctgattatcaaaattatattaagacgtgtggtttttatgttgattactatcaatatttgggtgcaccacattttgatcgagctccagcaatcatgacgtttattaatcatgacctggaaaagctcgaccttgattatgtccatgatttgaaagcaaagacttttccgcatcaagatggaaataacgcacaacgagtatttcagtttttgatgaaacaactctaaatatttagtagggagcgcataatttatgttacaacgattaaaacggattgcgcggcgtgtcgtctatggacggcgggcaccagttaacgatacgcaagaattaacggaaccgaccgggccgcaaagtgatgcgcttgaatttatgaactcgcaacgaatcgccaagaatgccgaatcattgatcaaacgacaagtgactaaacttgattttaatagttcttacttagttattgaaggttcagcatggtttgaaaagtatcctgaaaaagatgccgagcggattattaagagtttgattctaattaacgatcaggccgaagaaattgaaattccgttggttaatacgactgttgaacggcccggatttccagcttctggttatcatggtgacgttaacttttcaacgatttctgatggaaagccactaatacctggtacttatgaaattaaattacaactgcaacagtatttaggcaatggttggctaattcggcggacttcaattggacaaatcgttgatacccatcaggatttgaactataccactaaaatgacgagttattcggccaagagtaataaatcatacagcttaattttccgctatagcttagcttcacaagcattgaaggtcacttcatacaaactgagtgatgttaatccgcttgaaaatgaatttaccgaagacgtcggcttagatagtgcggcgatgcgtgccattaaacgccgggcgctaaaactctggtatcggtggtactgccttcaaccgattcataagaaacaaatttcatttgtttccgatagccgggtgacgatctccggtaatttcgaatttatttatcaggaattaaaacgtcgcaatactgattttaagatttcattctatttgaagccaagtattaaaaccaaaaaatcctggaaagaggttcgaacgttagctaaagcgttggctactagtcgttatgtgattttagatgacttttacccactagtttacccattgcatatccgggaaaatgcggatttgattcaggtatggcatgcggtcggtgcctttaaaacgtttggttacagccgactcgggatgcctggtggtcctaagattcaatcactgaaccatcgtaattacaccaaagccttggtttcttcgcataacattgcggataagtacgcggaagggtttgggattactccagataagattcagccgctggggataccacggacggatatctttttcgatgagcctaagaaacaggcgattcgagaacgactagcgcatgacctgccattcatcaagggcaaaaaagtcattctctttgccccaacgttccgtggcaatggccagcaatcagcatactatccatttgaaatgttgaattttagagcaatctacgaagcattacacgaagattacgtctttttactgaagattcatccgtttgtgcaaaacaaaccaacgttaccatatgaatattcggacttctattacgatgtttctgattatcgtgagatcaacgatttattactcgttgctgaccaattaatcactgactactcatcagtttgtttcgaatacgcactactgaaccggccaatgattttctttgcgccggacttagcggattacatgcaatcccggagtttttacttcaactactttgattttattcctggtagtttagcggaaaacacgggtgagttgatcagccagttgcaacatccacaagttgaccaagctaaattggacggctttgtgaacttcttctttgatgatctagatggtaagtctacagctcgtttcgtggatgcacttgaaaatgacttcgaggatccgaacgcagctgagttagaaaataacgacggtctcgccattagtgaagatggtaagattatccctgattggggtaaaaaggctaaataatatgggctctttgtcaaatcctgttgatgaatagcttttacagagttgaaagtcatgcgactttcaactctgtttttttcattggttttgttctcatttgccgtaacttaatacgtgaaatcatatgatggtaattacggaatccaaatgctgtgcgttgaatttgtttaatcattcgattcatgccttcgactgggccattcgtatagtccgattcactggcgttgagtacaaccactaagttctttttgaacgtttgaaacactgctttcatgtagggacttatattttgatttgtatatagatcttccacaagcttgtctttgtcttgattcttaaggttttccatgatgctttgcatcgactcgtacgatgctttaagttcttcgttaattgtcagtccttgttctacacgttctagttgtgtgagttgttttcgcaggtgtcggtcataaaagacatgttcctcatctagatttccggcatacttcaaataaagccgccaggcgaactttaacgtgcgatattcataggatcttttattgtactttttcatggtttgcacccgagtttgattaaaagctcgagtcatcattgcaacgatgtgaaagcggtcgatcacaatttttgcctgcggaaacattgccttggcaatgtcttgatagtaactatttagatctacggtaactgttttgacacgtgctcgaacacttgctggaaattgtttaaaataatcagtaatactttgcttgaatcggtctggcagaatttgttgaatttcgtgctcaccagcgccattaatacagatgaaatggagccgaccaccaattcctctaaattcatccatggcgagatgaaccggtagatagttaagatttctgcgaaataagtcatcatagttgtctaagtaacgacagacagtgctagctgatatgccggcatcgaccgcaatgctagcttgagtgcggtcgtcttgtagactcataaacactttctgacgcgtggctcgggagatacaacagtacttgtctaccacatcagaagtagccataaacgacgctttacaattacgacaaatgacgcgttctttatggagttctaaataaactggttcactcgcattcgctgccagataggtcacgcgtgatacgtagtgtccattatgacttagctcgcaaaagccacagttagcgcaatgtttctggtcgaacttaaccgtggctatatatacttttgcgcgcttagctttaatcacttgatagttatatttgtaaaaaactacatttgggtctttaatactgagcgcaaattttatattattatctacagggtccataagttttcacgtcctttaaaaaagatgctgtagtgggtggattttttaggtgcgaggcttatgggccttttttattttgcggtgaattttcaaattaagtgtaaagtctcattatagaaaacttcgtagggtgttctccaacccagacacttcttgggccgggtattcaatttatgagcgtactctgcgaattctggtgcaggaatatcagacatgtcttgagacttaggaagatactcacggagcagattgtttgtattctcattcgtgcctctttgccaaggagcgtgtggatctggaaagtaaaattcaataccagtttcttctgtgatctcaacgtgtttagcgaattctttgccacgatctggtgtgatggttttaacgtccttgatagggagcttagctgtcaaagccaggacaatctgggctacttcagctgatttctttttgtctgcttttccaatcaagcagaacctggagtagcggtcaaccattgtgactgcacaagccttaccagtttttccggcaaccgtatccagttcccaatgaccaatttcagtacggtcatcggcggccaaaggtcgctcatgaatggtgttactgatctgaatcttgccccggcgttcaatgtggcctttagtatgtctagtcttaccgcgatgcctgagttttcggactgcaccgcgattgccgtgagataagcctgtttcgttgaagtccccacggtaaatagcccgatagatcgtattgtaactcacttgataactagatttttcatgtttcaagcgttgatctatttcttctggagaccactgttcttcaaggaaaaaatgtttaacgacatcaaaaatcttggtgtccgtaaatactcgttttcggccacacttttgtttgcgggctgcgtataaacgtgttgcttttgagggagagtataggccatgttgtgaatttcaatttaactctcggctgatcgtgctgggactacgtttcagctccctgccaattactttcagagtttctccttgttcatgcattacaaatatccgttcacgttcacctgtggtaagatgttggtagggattcatagctaagacctgcctttcaatgtttgttgtcgttaacacccattgtacaggattctagctatgagtcctttttcttgcacttatcatcttgcacttaaattgtaaatcaaaggcactaaaaaatcctgctaatagattaccatgttaagtaagccatcaacaggaaaaagtatagaaccataatatgttaagataaagcagtcagtcacatcatcagcgcatttacagcgttgattgtgtgaccgactgtttttgctaggaaactataggaggaattgatcatgtcacaaattacgacacggcggctcaccactgctgacgtgaacaaactacaacaaatcagtattgaaacctttaaggacacgtttggtgcacaaaacacctctgaaaatatggccgcatacttacaagatgcatataacttgcccaagttaacccatgaattagcggaacccgaatcacaattttattttgttgaacgagccggtgagtcattaggatacttgaaattaaacaccggtgcggcacaatcagaagcaatgggtccagacactttagaagttgaacgaatctatatccgaaaagctttccaacaccaagggctcggtaatcaatttatgcaacaagcgattcaaattgctaaagctaatcacaagcataaagtttggcttggcgtttgggaacataatgaactggcaaaggacttctatgcgaaatggggctttgaacaattcagtgctcacgattttgtgatgggtgacgatcgccaaaccgatttactcatgattaagtcgctgactcaggactagatcggaagtcgctgcctaattgacgacaccacccaagcagcttgttcttgaaaattaaaaattgtccgaagttcgtggctgtgccattaaaaatcgaactaccccttgtttttgttaagaaaggggcttatactattaatcaatcgcacacgattgaaaggagcatctgcatgacactagaaattgacctagcaaatcaactttgttttagcatatacaatgccaatcggttatttaacaaattttatgtcgaaacattaacgccattcaagctgacttacgcacaatatctcgtactaatggcattgtgggaacgcgacgatcagtcactacacgaattgggtcaagttctgcgtttaagtagcaacactctgacaccacttttgcggcgtatggaagacgccgggtggttgcaacgggagcgcccagcaacggatcggcgtcaattggttattcatcttacaactcaaggcaagcaacaacaagcaccaatcgaagccgcgattgcaacttgtatcagtcgctaccatctgaccatcgatgaatatcagcaggctttggccttgaaccagaagatcattaccgcattatcacaagatttggcctagatgggcctttttattggccatttcaatcgtgcacgactgaattataaatttaggaggaatctttaatggcagattatgacacaatttttatcggtagcggtcacgcgacgtggcacgctgcagtgatccttgcacgtgcgcaacaaaaggtagcaatcattgaagaggatacaatcgccgggacatgcactaactttggttgtgatgctaagattctgttagacggccccttcgagctgaccgaacagctcaaacaataccaggggattggtgtcaacacaacgcccagtatcgattggtcacagttgatggcatataagcagcaagtcattcaacccttatcggtacaaatgacggccgtattcaagcaattagggattaagattattacaggacatggcgaactgactgatacgcacactgttaaagtggccggcagcacgtatacggcggataccatcgttgtcgggaccggacagcgcccagccaaattagctattccgggcgctgatctaatgcatgatagtcgtgattttcttgacctaccaaccatgcccaagcggttgaccttgattggtgccggaattatctcgttagaatttgccaacatggctgtgttactaggatctgaagtgcatattattgagtttgccgaccgggcactacctgcattttattcagagcacgttgaaaaaatgattgcacatttacaggcagccggggtacacttccactttggtgaagcccttagccaagtgactaaaagcgccacgggattattggcaaccactaagaacggcctgaccattgagagtgatgacatcatcacagccactggtcggattccaaacattgaacacttagggttaacgaaagttggcattaagaccgatcggcacggcattatcgtcgacgaccatttgcagacaaatattcccaacatttacgctagcggtgatgtcatcagcaagactttgccgaaattaacaccgaccgcgacctttgagtctaactacattgccggccaattgcttggaagtacggccgctattgattatccggtcattccatcggtcgtctttacgttaccaagaatcgcacaagtcggtatccctgtcgaagccgccaagcttgatactgaacactttcacgttcaagcactgccatacggtaaactgttagcctttcagtatcaaaacgaggtcgatgctgatctacaactgatctttgaccaagagaattaccttgttggcgcctccatctatggtaatggcgcgccagacttgattaacttactgaccatgattattactgatcacgtctcagccaacacgttaagtcagaagatttttgccgttcgagactaactcaccgatagttcatgcctagggcccctaataatttgacaagcaggataatggccccaccgagcgtccaaatgaagacgccccagcttaaccaactggcctgaacaaataaactgatcaaaatgaaccaattcatcccaaagagccaccaactgagtgtgcctttcagaatcattgaccatacaaagggtgtcgtataccgatttagcgggataatcgcaagcaatagggccggaatgagcatactttcaaacattgccaaataatggtacggatcgctcgtataagcgattgcccccaataaaccatagtgatttggtatcgtcgttaaaagggctgcttgcccaatataaacgatgattggttggccaatcaacagtgcgagtaatccccaagttatctttttcatcagtctacgccgtccttattgtttaataacactatcttaccaatctacataggcgcctaactaccgaataattgtaaacttctcgtgaaaaagacgtaaagaatgagcatgattcgttcactatgttttcataacataaataataggcattttaaaaaagtatgcgtataataccttcttaataagtttctatgggggagttatgatgataatagttcgagttgcaattacgatttcagtcgttttttacttgtattttattattaatttattgttgatcaatcactatcgggagcccattcaaagctatgaaaaagggcccacaccctatgaattgtttttggttattccggtgctcaatgaagagcacgttatctcacaaacgattacgcaattgactgaatctctcgaacggttaccaccaactgttcacgcccaaataattgccgttgatgacgattcgactgatcacagtctgttgttgctaacccagtcatcatcgcgcttcttacaaatcctacaccgcacgggtaaccagcgtgcaggtaagggggccgtcctcaacactgccgtccagtatattcataagacgttagcgctaaaatctgatccgcagcggacgatcgtgggggtcctagatgccgacgcgtttatgaatactgctgacttgacacgagtacttgcgcactttgaacaagaaccacagttggccatgatccaaacgagtgtgaatatctacaatcagcccaattggctgactaagatgcagaattttgagttcatgggggttaataatgctacccaacagttacgcaatcgccttggtcaggggattgcgtcgggaaatggacaattcgtccggctagatttagcattacagaatccatgggggaatagcttactcgaagatctcgaatttactttgcggacttggctgttaggtggtacccgaacagcttttgatcataccttagttgttcagcaagaggccgttgaacaactacgcccattttttcgtcaacgggtgcgctggtgtcaaggcgccgtacaatgcatgcgctatttaccagcactttggcgttcgggacgcctgaaccattttcaaaaattggacacgactttttggattctgatgcctatcagtggttgtatcgtgccactgaccagtctgatcacgatagtcgtgcttgtgagtcgtagcttgcaacattggcaagttgggtggcatcatttggctatcggaacattactagtgattgccttttcagcttgtttagtattagcagcgctgtatcagcgcaactatgctgtcgtgaaacaacccgttggcttcttggatgctctcaagcagagtttaacctttcaagcattcctattaatcattagcctgacaccatacgtctccatttaccggcagttgcgtggtcaaacggggtgggctaaaacgcgccatggtgtcacgacccccgttgcaaaatacccagatactggcttgaaacgctcatattaagatgaaggtgcatgccgatgaagtggtgctataagatatttcaaattaccgttctcacgattgcagctgccttactcgggtggatgattgtcgccaactggcaagtcaacctgaaattacacctcgcaatcagtgcttggataggcgctggtttattcgtattgttcattggtgccacgattggccttggcagctggtggttgagccgccaccaaactagctggttagttgcagcactgatggggttaactatcttaaaatttccactagttgcagggttaaagatcgacccgacctcagatttctggaattaccatacactagccgcgtttagtgcccaaggattcacctggacccaactgttacaccatggtatcgttggcaattacgtcgtttttccgcacgctttaaatatcgcgaacggctacagtttagtcgcggcttttggcggggccaacttttttgtcagccaactaatcaatattgggtgtactttagtcgatatggtcttaatttactggctagtcgcacggtggctctcacgacaattaggcatcatggctgccctcattttttactggattccagcttattggctgtacggcacgctcttaaatggtggtgaaccgttctttttcaccagcgtcctgctcatgatgtatgcgctgacgcgggcattagttccactcacgacgaccacaatcacggatcgacgactatacctagcgttagcgatcgtgatgactgtcgtggccaatatgctgaggccaatcatgggcgtctggctaattgcactgggtttgatgagtttgtgtgtcctgcttaagtctcaccacctttaccgcgttcaagtacgtcagctcctcatatacagtgcggtcgtgttagggctcatgttcacagcgactaatctcgacagctggttatatggctttaaggttgcgccagcccaagttgaaactttatacagcctggctacggggacagatgttaaaagtcacgggacctatagcccggcactacaagctaccgtcagccacgaattacgggtggcgcccacgttgacgcaagcctatccgcgaatcacacgaacgatggcgaggactttacagactaatctcaaacaaatcaagccacagttggggtcatttgttaatgaaaaaatgcagggctttattcgtgaggattatggctatgattggagcttatataacttaagccatcatcccggtttgcttaaccgccactggttttatttagcccctatattgattacaagtgcgacggtttattggcaggcaatgctggtgattgcgttattcagtgttttaatggggctgggactgctatggcaccggcactatctcaatcgctatttgctgatgggagcgctgttactagatggttgcactttaagtgccttaccattagaagtacagggccgctatcatattatcttgtacttaccaatccttatgttgatgacttgcgggatcgcgggggccaagctctggtggcgtcaaatcaagcagagttgagtggcaggggccatgtcaaaatcaatgcccaaatggattgttagcgttcgaagctcactgaatgaaaattaagctgatgatataaaaaagattattgctgacagtagtgactgttacttcagtaataatctttttataatgtttaaaaggggacagatcgtctaatttgtactatcaaattattgtggctacggtcatagttaatagctggcactgccagtatcgttagcaaataccacggatcaattgactttaatggcccgtaatccccatttactaatgccgattgggtgctcgtcaaggtgccaggacagcccggtgatgaccactaaataattgattgctcttcgccaacatgtcatggcaacgggtttcaagctagggcgacagtcagtactatgggcgatggatgacgctgttagtggctgggggggcggttcggcgtaattacgcgggctagcaaaatcattgctatgagccgtcatgtcaatccgccaggcttcagccaaaacgtgtgttgcaatggatattgtcgtcaaaaccattgaattgcccaattgatccgataaaactggtgctgaagcggttttagaatgcgttgaaatggaataggcttaaaagtagggcgaccgggggctattttcgaccgggtaggggttgtcacaaaaggttgaaatgaaccccaacgacccatttgggcgtaatatcggtttgcgtgatgacattgcgttcgtg

(The sequence listing continues in the following parts.)

What is claimed is:

1. A method of increasing Cisd2 gene expression in a subject, comprising:

administering an effective amount of a composition to a subject;

wherein the composition comprising an active substance of *Lactobacillus plantarum* of an effective amount, wherein the *Lactobacillus plantarum* No. 14565 is deposited at China General Microbiological Culture Collection Center;

wherein the active substance is prepared by the following method:

(a) streaking the *Lactobacillus plantarum* on a solid-state media to produce single colonies; and (b) inoculating a single colony of the *Lactobacillus plantarum* cultured at step (a) to a liquid culture for liquid-state culture;

(c) centrifuging the liquid culture cultured at step (b) to obtain a bacterial pellet; and (d) freeze-drying the bacterial pellet obtained at step (c);

wherein the active substance is a freeze-dried *Lactobacillus plantarum*.

2. The method of claim 1, wherein step (b) is carried out at 30 to 50° C., in nitrogen or carbon dioxide of 0 to 1 VVM, rotate at 10 to 100 rpm, or incubate for 16 to 24 hours.

3. The method of claim 1, wherein a temperature for the freeze-drying at step (d) is −196 to −40° C.

4. The method of claim 1, the composition comprising an additive selected from the group consisting of an excipient, preservative, diluent, filler, absorption enhancer, sweetener and a combination thereof.

5. The method of claim 1, the composition being a drug, feed, drink, nutritional supplement, dairy product or health food.

6. The method of claim 1, the composition taking the form of a powder, tablet, granule, suppository, microcapsule, ampoule/ampule, liquid spray or suppository form.

7. The method of claim 1, wherein, after the administering step, the subject exhibits reduced and delayed mitochondrial damage compared to a subject that has not been administered the active substance.

8. The method of claim 1, wherein, after the administering step, the subject exhibits delayed aging conditions of nerve degeneration, sarcopenia or a combination thereof, compared to a subject that has not been administered the active substance.

9. A method of delaying nerve degeneration and sarcopenia in a subject, comprising:

administering an effective amount of a composition to a subject;

wherein the composition comprising an active substance of *Lactobacillus plantarum* of an effective amount, wherein the *Lactobacillus plantarum* No. 14565 is deposited at China General Microbiological Culture Collection Center;

wherein the active substance is prepared by the following method:

(a) streaking the *Lactobacillus plantarum* on a solid-state media to produce single colonies; and (b) inoculating a single colony of the *Lactobacillus plantarum* cultured at step (a) to a liquid culture for liquid-state culture;

(c) centrifuging the liquid culture cultured at step (b) to obtain a bacterial pellet; and (d) freeze-drying the bacterial pellet obtained at step (c);

wherein the active substance is a freeze-*dried Lactobacillus plantarum*.

10. The method of claim 9, wherein step (b) is carried out at 30 to 50° C., in nitrogen or carbon dioxide of 0 to 1 VVM, rotate at 10 to 100 rpm, or incubate for 16 to 24 hours.

11. The method of claim 9, wherein, after the administering step, the subject exhibits reduced and delayed mitochondrial damage compared to a subject that has not been administered the active substance.

12. The method of claim 9, wherein, after the administering step, the subject exhibits delayed aging conditions of nerve degeneration, sarcopenia or a combination thereof, compared to a subject that has not been administered the active substance.

* * * * *